United States Patent
Shayman et al.

(10) Patent No.: US 8,052,970 B2
(45) Date of Patent: Nov. 8, 2011

(54) LYSOSOMAL PHOSPHOLIPASE A2 (LPLA2) ACTIVITY AS A DIAGNOSTIC AND THERAPEUTIC TARGET FOR IDENTIFYING AND TREATING SYSTEMIC LUPUS ERYTHEMATOSIS

(75) Inventors: James A. Shayman, Ann Arbor, MI (US); Akira Abe, Ann Arbor, MI (US); Robert Kelly, Trenton, MI (US); Jessica Kollmeyer, Ypsilanti, MI (US); Ye Lu, Ann Arbor, MI (US)

(73) Assignee: The Regents of the University of Michigan, Ann Arbor, MI (US)

( * ) Notice: Subject to any disclaimer, the term of this patent is extended or adjusted under 35 U.S.C. 154(b) by 0 days.

(21) Appl. No.: 12/495,209

(22) Filed: Jun. 30, 2009

(65) Prior Publication Data
US 2009/0324575 A1 Dec. 31, 2009

Related U.S. Application Data

(60) Provisional application No. 61/076,913, filed on Jun. 30, 2008.

(51) Int. Cl.
*A61K 38/46* (2006.01)
(52) U.S. Cl. ............ 424/94.6; 424/94; 435/375; 435/19
(58) Field of Classification Search .................. None
See application file for complete search history.

(56) References Cited

U.S. PATENT DOCUMENTS

| | | |
|---|---|---|
| 4,179,337 A | 12/1979 | Davis et al. |
| 4,289,872 A | 9/1981 | Denkewalter et al. |
| 4,301,144 A | 11/1981 | Iwashita et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,861,719 A | 8/1989 | Miller |
| 4,892,538 A | 1/1990 | Aebischer et al. |
| 5,139,941 A | 8/1992 | Muzyczka et al. |
| 5,229,490 A | 7/1993 | Tam |
| 5,252,479 A | 10/1993 | Srivastava |
| 5,283,187 A | 2/1994 | Aebischer et al. |
| 5,328,688 A | 7/1994 | Roizman |
| 5,474,935 A | 12/1995 | Chatterjee et al. |
| 5,585,362 A | 12/1996 | Wilson et al. |
| 5,622,856 A | 4/1997 | Natsoulis |
| 5,658,776 A | 8/1997 | Flotte et al. |
| 5,661,033 A | 8/1997 | Ho et al. |
| 5,670,488 A | 9/1997 | Gregory et al. |
| 5,686,278 A | 11/1997 | Williams et al. |
| 5,693,509 A | 12/1997 | Cotten et al. |
| 5,707,618 A | 1/1998 | Armentano et al. |
| 5,770,414 A | 6/1998 | Gage et al. |
| 5,773,289 A | 6/1998 | Samulski et al. |
| 5,789,390 A | 8/1998 | Descamps et al. |
| 5,824,544 A | 10/1998 | Armentano et al. |
| 5,830,725 A | 11/1998 | Nolan et al. |
| 5,830,727 A | 11/1998 | Wang et al. |
| 5,834,441 A | 11/1998 | Philip et al. |
| 5,849,571 A | 12/1998 | Glorioso et al. |
| 5,851,521 A | 12/1998 | Branellec et al. |
| 5,856,152 A | 1/1999 | Wilson et al. |
| 5,863,541 A | 1/1999 | Samulski et al. |
| 5,879,934 A | 3/1999 | DeLuca |
| 5,888,502 A | 3/1999 | Guber et al. |
| 7,319,015 B2 * | 1/2008 | Shayman et al. ............... 435/21 |
| 7,582,442 B2 * | 9/2009 | Shayman et al. ............... 435/21 |

FOREIGN PATENT DOCUMENTS

| | | |
|---|---|---|
| EP | 0273085 | 7/1988 |
| EP | 0367566 | 5/1990 |
| WO | WO-91/18982 | 12/1991 |
| WO | WO-93/21259 | 10/1993 |
| WO | WO-93/25673 | 12/1993 |
| WO | WO-94/03564 | 2/1994 |

OTHER PUBLICATIONS

Abe et al., "A novel enzyme that catalyzes the esterification of N-acetylsphingosine. Metabolism of C2-ceramides", *J. Biol. Chem.*, 271:14383-9 (1996).
Abe et al., "Lysosomal phospholipase A2 is selectively expressed in alveolar macrophages", *J. Biol. Chem.*, 279:42605-11 (2004).
Abe et al., "Positional specificity of lysosomal phospholipase A2", *J. Lipid Res.*, 47:2268-79 (2006).
Abe et al., "Purification and characterization of 1-O-acylceramide synthase, a novel phospholipase A2 with transacylase activity", *J. Biol. Chem.*, 273:8467-74 (1998).
Abe et al., "The acylation of lipophilic alcohols by lysosomal phospholipase A2", *J. Lipid Res.*, 48:2255-63 (2007).
Abe et al., "The secretion and uptake of lysosomal phospholipase A2 by alveolar macrophages", *J. Immunol.*, 181:7873-81 (2008).
Anderson, "Human gene therapy", *Nature*, 392:25-30 (1998).
Ballas et al., "Liposomes bearing a quaternary ammonium detergent as an efficient vehicle for functional transfer of TMV-RNA into plant protoplasts", *Biochim. Biophys. Acta*, 939:8-18 (1988).
Baumann et al., "Impaired uptake of apoptotic cells into tingible body macrophages in germinal centers of patients with systemic lupus erythematosus", *Arthritis Rheum.*, 46:191-201 (2002).
Behr et al., "Efficient gene transfer into mammalian primary endocrine cell with lipopolyamine-coated DNA", *Proc. Natl. Acad. Sci. USA*, 86:6982-6 (1989).
Behr et al., "Gene transfer with synthetic cationic amphiphiles: prospects for gene therapy", *Bioconjugate Chem.*, 5:382-9 (1994).
Behr, "DNA strongly binds to micelles and vesicles containing lipopolyamines or lipointercalants", *Tetrahedron Lett.*, 27:5861-4 (1986).

(Continued)

*Primary Examiner* — Hope Robinson
(74) *Attorney, Agent, or Firm* — Marshall, Gerstein & Borun LLP

(57) ABSTRACT

The present invention is directed to methods for diagnosis and treatment of systemic lupus erythematosus and drug-induced systemic lupus erythematosus. More specifically, the specification describes methods using a lysosomal phospholipase A2 in methods for the diagnosis and treatment of autoimmune disorders such as systemic lupus erythematosus and drug-induced systemic lupus erythematosus.

4 Claims, 18 Drawing Sheets

OTHER PUBLICATIONS

Benvenisty et al., "Direct introduction of genes into rats and expression of the genes", *Proc. Natl. Acad. Sci. USA*, 83:9551-5 (1986).

Bombardier et al., "Derivation of the SLEDAI. A disease activity index for lupus patients. The Committee on Prognosis Studies in SLE", *Arthritis Rheum.*, 35:630-40 (1992).

Chen et al., "High-efficiency transformation of mammalian cells by plasmid DNA", *Mol. Cell Biol.*, 7:2745-52 (1987).

Cohen et al., "Delayed apoptotic cell clearance and lupus-like autoimmunity in mice lacking the c-mer membrane tyrosine kinase", *J. Exp. Med.*, 196:135-40 (2002).

Cosman et al., "Cloning, sequence and expression of human interleukin-2 receptor", *Nature*, 312:768-71 (1984).

Cosman et al., "High level stable expression of human interleukin-2 receptors in mouse cells generates only low affinity interleukin-2 binding sites", *Mol. Immunol.*, 23:935-41 (1986).

Dubensky et al., "Direct transfection of viral and plasmid DNA into the liver or spleen of mice", *Proc. Natl. Acad. Sci. USA*, 81:7529-33 (1984).

Ehrenstein, "Antinuclear antibodies and lupus: causes and consequences", *Rheumatology* (Oxford), 38:691-3 (1999).

Ellison et al., "The nucleotide sequence of a human immunoglobulin C gamma1 gene", *Nucleic Acids Res.*, 10:4071-9 (1982).

Englehard et al., "The insect tracheal system: a conduit for the systemic spread of *Autographa californica* M nuclear polyhedrosis virus", *Proc. Natl. Acad. Sci. USA*, 91:3224-7 (1994).

Erwig et al., "Immunological consequences of apoptotic cell phagocytosis", *Am. J. Pathol.*, 171:2-8 (2007).

Fechheimer et al., "Transfection of mammalian cells with plasmid DNA by scrape loading and sonication loading", *Proc. Natl. Acad. Sci. USA*, 84:8463-7 (1987).

Felgner et al., "Lipofection: a highly efficient, lipid-mediated DNA-transfection procedure", *Proc. Natl. Acad. Sci. USA*, 84:7413-7 (1987).

Felgner, "Improvements in cationic liposomes for in vivo gene transfer", *Hum. Gene Ther.*, 7:1791-3 (1996).

Felgner, "Nonviral strategies for gene therapy", *Sci. Am.*, 276:102-6 (1997).

Ferkol et al., "Regulation of the phosphoenolpyruvate carboxykinase/human factor IX gene introduced into the livers of adult rats by receptor-mediated gene transfer", *FASEB J.*, 7:1081-91 (1993).

Fraley et al., "Entrapment of a bacterial plasmid in phospholipid vesicles: potential for gene transfer", *Proc. Natl. Acad. Sci. USA*, 76:3348-52 (1979).

Friedmann, "Progress toward human gene therapy", *Science*, 244:1275-81 (1989).

Gopal, "Gene transfer method for transient gene expression, stable transformation, and cotransformation of suspension cell cultures", *Mol. Cell. Biol.*, 5:1188-90 (1985).

Graham et al., "A new technique for the assay of infectivity of human adenovirus 5 DNA", *Virology*, 52:456-67 (1973).

Greenspan et al., "Idiotypes: structure and immunogenicity", *FASEB J.*, 7:437-44 (1993).

Greenwald et al., "Poly(ethylene glycol) conjugated drugs and prodrugs: a comprehensive review", *Crit. Rev. Ther. Drug Carrier Syst.*, 17:101-61 (2000).

Gronich et al., "Identification and characterization of a hormonally regulated form of phospholipase A2 in rat renal mesangial cells", *J. Biol. Chem.*, 263:16645-51 (1988).

Hanayama et al., "Autoimmune disease and impaired uptake of apoptotic cells in MFG-E8-deficient mice", *Science*, 304:1147-50 (2004).

Hanayama et al., "MFG-E8-dependent clearance of apoptotic cells, and autoimmunity caused by its failure", *Curr. Dir. Autoimmun.*, 9:162-72 (2006).

Hargraves et al., "Presentation of two bone marrow elements; the tart cell and the L.E. cell", *Mayo Clin. Proc.*, 23:25-8 (1948).

Harland et al., "Translation of mRNA injected into *Xenopus* oocytes, specifically inhibited by antisense RNA", *J. Cell Biol.*, 101:1094-9 (1985).

Harris et al., "Pegylation: a novel process for modifying pharmacokinetics", *Clin. Pharmacokinet.*, 40:539-51 (2001).

Hiraoka et al., "Cloning and characterization of a lysosomal phospholipase A2, 1-O-acylceramide synthase", *J. Biol. Chem.*, 277:10090-9 (2002).

Hiraoka et al., "Lysosomal phospholipase A2 and phospholipidosis", *Mol. Cell Biol.*, 26:6139-48 (2006).

Hiraoka et al., "Structure and function of lysosomal phospholipase A2: identification of the catalytic triad and the role of cysteine residues", *J. Lipid Res.*, 46:2441-7 (2005).

Hofstra, "Metabolism of hydralazine: relevance to drug-induced lupus", *Drug Metab. Rev.*, 26:485-505 (1994).

Imai et al., "A morphological and immunohistochemical study of lymphoid germinal centers in synovial and lymph node tissues from rheumatoid arthritis patients with special reference to complement components and their receptors", *Acta Pathol. Jpn*, 39:127-34 (1989).

Kaneda et al., "Increased expression of DNA cointroduced with nuclear protein in adult rat liver", *Science*, 243:375-8 (1989).

Kato et al., "Expression of hepatitis B virus surface antigen in adult rat liver. Co-introduction of DNA and nuclear protein by a simplified liposome method", *J. Biol. Chem.*, 266:3361-4 (1991).

Klein et al., "High-velocity microprojectiles for delivering nucleic acids into living cells", *Nature*, 327:70-3 (1987).

Kopecek et al., "Water soluble polymers in tumor targeted delivery", *J. Control. Release*, 74:147-58 (2001).

Kotani et al., "Lymph macrophages enter the germinal center of lymph nodes of guinea pigs", *Acta Anat (Basel)*, 99:391-402 (1977).

Kuntz et al., "The cellular basis of the impaired autologous mixed lymphocyte reaction in patients with systemic lupus erythematosus", *J. Clin. Invest.*, 63:151-3 (1979).

Letsinger et al., "Cholesteryl-conjugated oligonucleotides: synthesis, properties, and activity as inhibitors of replication of human immunodeficiency virus in cell culture", *Proc. Natl. Acad. Sci. USA*, 86:6553-6 (1989).

Leventis et al., "Interactions of mammalian cells with lipid dispersions containing novel metabolizable cationic amphiphiles", *Biochim. Inter.*, 22:235-41 (1990).

Lorz et al., "The death ligand TRAIL in diabetic nephropathy", *J. Am. Soc. Nephrol.*, 19:904-14 (2008).

Lu et al., "Homeostatic regulation of the immune system by receptor tyrosine kinases of the Tyro 3 family", *Science*, 293:306-11 (2001).

Malone et al., "Cationic liposome-mediated RNA transfection", *Proc. Natl. Acad. Sci. USA*, 86:6077-81 (1989).

Merrifield, "Solid phase synthesis", *Science*, 232:341-7 (1986).

Miller, "Human gene therapy comes of age", *Nature*, 357:455-60 (1992).

Nachman et al., "Pseudodipeptide analogs of the pyrokinin/PBAN (FXPRLa) insect neuropeptide family containing carbocyclic Pro-mimetic conformational components", *Regul. Pept.*, 57:359-70 (1995).

Nathan et al., "Hydrogels based on water-soluble poly(ether urethanes) derived from L-lysine and poly(ethylene glycol)", *Bioconjug. Chem.*, 4:54-62 (1993).

Nathan et al., "Copolymers of lysine and polyethylene glycol: a new family of functionalized drug carriers", *Macromolecules*, 25:4476-84 (1992).

Nicolau et al., "Liposome-mediated DNA transfer in eukaryotic cells. Dependence of he transfer efficiency upon the type of liposomes used and the host cell cycle stage", *Biochim Biophys Acta*, 721:185-90 (1982).

Ohmori et al., "The enhancing effect of anionic alpha-helical peptide on cationic peptide-mediating transfection systems", *Biochem. Biophys. Res. Commun.*, 235:726-9 (1997).

Okayama et al., "A cDNA cloning vector that permits expression of cDNA inserts in mammalian cells", *Mol. Cell. Biol.*, 3:280-9 (1983).

Perales et al., "Gene transfer in vivo: sustained expression and regulation of genes introduced into the liver by receptor-targeted uptake", *Proc. Natl. Acad. Sci. USA*, 91:4086-90 (1994).

Perez-Garcia et al., "Drug-induced systemic lupus erythematosus in ankylosing spondylitis associated with infliximab", *Rheumatology* (Oxford), 45:114-6 (2006).

Pinnaduwage et al., "Use of a quaternary ammonium detergent in liposome mediated DNA transfection of mouse L-cells", *Biochim. Biophys. Acta*, 985:33-7 (1989).

Pollard et al., "Polyethylenimine but not cationic lipids promotes transgene delivery to the nucleus in mammalian cells", *J. Biol. Chem.*, 273:7507-11 (1998).

Potter et al., "Enhancer-dependent expression of human kappa immunoglobulin genes introduced into mouse pre-B lymphocytes by electroporation", *Proc. Natl. Acad. Sci. USA*, 81:7161-5 (1984).

Radler et al., "Structure of DNA-cationic liposome complexes: DNA intercalation in multilamellar membranes in distinct interhelical packing regimes". *Science*, 275:810-4 (1997).

Rahman, "Autoantibodies, lupus and the science of sabotage", *Rheumatology* (Oxford), 43:1326-36 (2004).

Rippe et al., "DNA-mediated gene transfer into adult rat hepatocytes in primary culture", *Mol. Cell Biol.*, 10:689-95 (1990).

Rose et al., "A new cationic liposome reagent mediating nearly quantitative transfection of animal cells", *Biotechniques*, 10:520-5 (1991).

Rubin, "Drug-induced lupus", *Toxicology*, 209:135-47 (2005).

Ruiz-Arguelles et al., "Novel facts about an old marker: the LE cell", *Scand. J. Clin. Lab Invest. Suppl.*, 235:31-7 (2001).

Saiki et al., "Analysis of enzymatically amplified beta-globin and HLA-DQ alpha DNA with allele-specific oligonucleotide probes", *Nature*, 324:163-6 (1986).

Savill et al., "Corpse clearance defines the meaning of cell death", *Nature*, 407:784-8 (2000).

Schaloske et al., "The phospholipase A2 superfamily and its group numbering system", *Biochim Biophys Acta*, 1761:1246-59 (2006).

Shayman et al., "1-O-acylceramide synthase", *Methods Enzymol.*, 311:105-17 (2000).

Smith et al., "Molecular Engineering of the *Autographa californica* Nuclear Polyhedrosis Virus Genome: Deletion Mutations Within the Polyhedrin Gene", *J. Virol.*, 46:584-93 (1983).

Smith et al., "Tingible body macrophages in regulation of germinal center reactions", *Dev. Immunol.*, 6:285-94 (1998).

Swartzendruber et al., "Electron microscope observations on tingible body macrophages in mouse spleen", *J. Cell Biol.*, 19:641-6 (1963).

Tabe et al., "Cell dynamics in the germinal center of the human tonsil", *Acta Otolaryngol. Suppl.*, 523:64-7 (1996).

Tam et al., "An SN2 deprotection of synthetic peptides with a low concentration of hydrofluoric acid in dimethyl sulfide: evidence and application in peptide synthesis", *J. Am. Chem. Soc.*, 105:6442-55 (1983).

Tanaka et al., "Apoptotic cell clearance and autoimmune disorder", *Curr. Med. Chem.*, 14:2892-7 (2007).

Tur-Kaspa et al., "Use of electroporation to introduce biologically active foreign genes into primary rat hepatocytes", *Mol. Cell Biol.*, 6:716-8 (1986).

Uetrecht et al., "Metabolism of procainamide to a hydroxylamine by human neutrophils and mononuclear leukocytes", *Chem. Res. Toxicol.*, 1:74-8 (1988).

Verma, "Gene therapy", *Sci. Am.*, 263:68-72, 81-4 (1990).

Wagner et al., "Transferrin-polycation conjugates as carriers for DNA uptake into cells", *Proc. Natl. Acad Sci. USA*, 87:3410-4 (1990).

Wilson et al., "The occurrence of L.E. cells and hematoxylin bodies in the naturally occurring cutaneous lesions of systemic lupus erythematosus", *Am. J. Med. Sci.*, 241:31-43 (1961).

Wu et al., "Evidence for targeted gene delivery to Hep G2 hepatoma cells in vitro", *Biochemistry*, 27:887-92 (1988).

Wu et al., "Receptor-mediated in vitro gene transformation by a soluble DNA carrier system", *J. Biol. Chem.*, 262:4429-32 (1987).

Wu et al., *Adv. Drug Delivery Rev.*, 12:159-167 (1993).

Xue et al., "A lupus-like syndrome develops in mice lacking the Ro 60-kDa protein, a major lupus autoantigen", *Proc. Natl. Acad. Sci. USA*, 100:7503-8 (2003).

Yang et al., "In vivo and in vitro gene transfer to mammalian somatic cells by particle bombardment", *Proc. Natl. Acad. Sci. USA*, 87:9568-72 (1990).

Zalipsky et al., "Poly(ethylene glycol)-grafted liposomes with oligopeptide or oligosaccharid ligands appended to the termini of the polymer chains", *Bioconjug. Chem.*, 8:111-8 (1997).

Zhou et al., "Lipophilic polylysines mediate efficient DNA transfection in mammalian cells", *Biochim. Biophys. Acta*, 939:8-18 (1991).

* cited by examiner

Fig. 1C. Deduced amino acid sequences of human, mouse, and bovine LPLA2s

```
HUMAN    1  MGLHLRPYRVGLLPDGLLFLLLLLMLLADPALHAGRHPPVVLVPGDLGNQLEAKLDKPTV
MOUSE    1  MDRHLCTCRETQLRSGLLLPLFLLMMLADLTLHAQRHPPVVLVPGDLGNQLEAKLDKPKV
BOVINE      MGCLCLYRSTLLTGGLLFLLMLADPAFHAGSRPPVVLVPGDMGNQLEAKLDKPSV
            *   *   *   ***    **    ********* ************ *

HUMAN   61  VHYLCSKKTESYFTIWLNLELLLPVIIDCWIDNIRLVYNKTSRATQFPDGVDVRVPGFGK
MOUSE   61  VHYLCSKKTDSYFTLWLNLELLLPVIIDCWIDNIRLVYNRTSRATQFPDGVDVRVPGFGE
BOVINE      VHYVCSKRTDHYFTLWLNLELLLPVIIDCWIDNVRLIYNQTSHTTQFPEGVDVRVPGFGD
            *** *** *  *** ************** ** ** **   **** ********

HUMAN  121  TFSLEFLDPSKSSVGSYFHTMVESLVGWGYTRGEDVRGAPYDWRRAPNENGPYFLALREM
MOUSE  121  TFSMEFLDPSKRNVGSYFYTMVESLVGWGYTRGEDVRGAPYDWRRAPNENGPYFLALREM
BOVINE      TFSMEFLDPSKSSVGSYLHTMVESLVSWGYERGKDVRGAPYDWRRAPNENGPYFLALRKM
            *** *******   **** ****** *** * * ************************ *

HUMAN  181  IEEMYQLYGGPVVLVAHSMGNMYTLYFLQRQPQAWKDKYIRAFVSLGAPWGGVAKTLRVL
MOUSE  181  IEEMYQMYGGPVVLVAHSMGNVYMLYFLQRQPQVWKDKYIHAFVSLGAPWGGVAKTLRVL
BOVINE      IEEMYQLYGGPVVLVAHSMGNMYMLYFLQHQPQDWKDKYIRAFVALGPPWGGVPKTLRVL
            ****** ************** * ****** *** ***** *** ** ***** *****

HUMAN  241  ASGDNNRIPVIGPLKIREQQRSAVSTSWLLPYNYTWSPEKVFVQTPTINYTLRDYRKFFQ
MOUSE  241  ASGDNNRIPVIGPLKIREQQRSAVSTSWLLPYNHTWSHEKVFVYTPTINYTLRDYHRFFR
BOVINE      ASGDNNRIPVIRSLKIRAQQRSAVSTTWLLPYSYTWSPQKVFVRTPKANYTLQDYRQFFQ
            ***********  **** ******** ***** ****  **** **  *** **  **

HUMAN  301  DIGFEDGWLMRQDTEGLVEATMPPGVQLHCLYGTGVPTPDSFYYESFPDRDPKICFGDGD
MOUSE  301  DIGFEDGWFMRQDTEGLVEAMTPPGVELHCLYGTGVPTPNSFYYESFPDRDPKICFGDGD
BOVINE      DIGFKDGWSMRQDTEGLVEATVPPGVRLHCLYGTGVPTPESFDYESFPDRDPKIHYGTGD
            **** ***  ********** **** ************ ** ********** *  **

HUMAN  361  GTVNLKSALQCQAWQSRQEHQVLLQELPGSEHIEMLANATTLAYLKRVLLGP
MOUSE  361  GTVNLESVLQCQAWQSRQEHRVSLQELPGSEHIEMLANATTLAYLKRVLLEP
BOVINE      GTVNLQSALHCHTWRGLQKQEVSLQALPGNEHIAMLANTTTLAYLKRVLLGP
            *****  *  *   *   *  * *  **  ** **** *********** *
```

WT                    KO

LYSOSOMAL PHOSPHOLIPASE A2 (LPLA2) ACTIVITY AS A DIAGNOSTIC AND THERAPEUTIC TARGET FOR IDENTIFYING AND TREATING SYSTEMIC LUPUS ERYTHEMATOSIS

CROSS-REFERENCE TO RELATED APPLICATIONS

This application claims the benefit under 35 U.S.C. 119(e) of U.S. Provisional Patent Application No. 61/076,913, filed Jun. 30, 2008.

STATEMENT REGARDING FEDERAL SPONSOR RESEARCH OR DEVELOPMENT

This invention was made with government support under Grant No. RO1DK055823 awarded by The National Institutes of Health. The government has certain rights in the invention.

FIELD OF INVENTION

The present invention is generally directed to methods for diagnosing and treating systemic lupus erythematosus (SLE) and symptoms thereof.

BACKGROUND OF THE RELATED ART

Systemic lupus erythematosus (SLE) is an autoimmune disease that affects multiple organs. The clinical manifestations are variable, but are often involve the skin, kidneys, liver, lungs, heart, and lymphoid organs. LPLA2 knockout mice (Hiraoka et al., Mol Cell Biol 26, 6139-6148, 2006) display a highly robust late onset lymphoproliferation that phenocopies SLE. More specifically, the mouse phenotype is characterized by splenomegaly, lymphadenopathy, penumonitis, hepatitis, and glomerulonephritis with renal insufficiency and immunoglobulin, C3 and C1q depositions. These mice are also characterized by high levels of circulating immunoglobulins and high titers of anti-nuclear antibodies (ANA) and anti-double stranded DNA antibodies (anti-ds-DNA). This striking phenotype raises the question of whether LPLA2 mediates the immunological processes that are aberrantly regulated in lupus.

Therefore, there remains a need in the art for a better understanding of the causes of SLE and for the identification of new therapeutic interventions for such autoimmune disorders.

SUMMARY OF THE INVENTION

Lysosomal phospholipase A2 (LPLA2) has several unique features, including lipase and transacylase activities, lysosomal localization, and acidic pH optimum. Based on these features, double conditional gene targeting was employed to elucidate the function of LPLA2. LPLA2 deficient mice were generated by the systemic deletion of exon 5 of the LPLA2 gene, which encodes the lipase motif essential for LPLA2 activity. LPLA2 null mice displayed features of systemic lupus erythematosus (SLE) that included late onset lymphoproliferative phenotype, expansion of lymphoid tissues, renal failure and glomerulonephritis, high circulating immunoglobulin levels, positive antinuclear antibodies (ANA) and anti-double stranded DNA antibodies, and the accumulation of undigested apoptotic or tingible bodies in macrophages.

The present invention unexpectedly demonstrates that LPLA2 mediates an immunological process that is aberrantly regulated in SLE. Thus, the present invention demonstrates a role for loss of LPLA2 enzyme activity as a marker of active SLE. Work described herein demonstrates that decreased levels of LPLA2 can be used as a diagnostic and therapeutic target for both identifying and treating symptoms of SLE.

As used herein, "LPLA2" means full-length lysosomal phospholipase A2 enzymes, also referred to as Group XV phospholipase A2, regardless of species of origin, as well as all fragments, derivatives and enzymatically active variants thereof. The term "variant" refers to additions, deletions or substitutions of amino acids. The term "derivative" encompasses additional chemical modification of LPLAs, such as chemical modification of amino acids or incorporation of modified amino acids, conjugation to hydrophilic polymers, or conjugation to other chemical moieties.

"LPLA2 enzymatic activity" refers to the ability of LPLA2 to degrade extracellular phospholipids to form free fatty acids and lyso-phophatidylcholine and lyso-phosphatidylethanolamine.

"LPLA2 catalytic consensus sequence" refers to amino acids -A-X-S-X-G- at positions 196-200 of SEQ ID NO: 1.

"LPLA2 autoantibodies" refers to antibodies produced by an individual that are immunospecific to the individual's own LPLA2 protein.

"Tingible body macrophages" refers to enlarged macrophages resulting from the inability of spleen cells to clear apoptotic cells.

As used herein, "SLE" includes systemic lupus erythematosus or any other autoimmune disease displaying the symptom of accumulation of tingible body macrophages. "Drug-induced lupus" refers to the onset of lupus symptoms such as the accumulation of tingible body macrophages upon chronic treatment with certain drugs.

The present invention provides methods for reducing the accumulation of tingible body macrophages in an individual comprising the step of contacting a cell having an accumulation of tingible body macrophages with an agent having LPLA2 enzymatic activity in an amount and over a time to reduce the accumulation of tingible body macrophages.

In one aspect, the agent having LPLA2 activity is a protein having an amino acid sequence selected from SEQ ID NOs: 1-288.

In another aspect, the agent is a mammalian LPLA2 enzyme. In one embodiment, the agent is a mammalian LPLA2 enzyme having an amino acid sequence selected from SEQ ID NOs: 1-288 or an enzymatically active fragment, derivative or variant thereof.

In yet another aspect, the agent is a human LPLA2 enzyme. In one embodiment, the agent is a human LPLA2 enzyme having the amino acid sequence in SEQ ID NO: 1 or an enzymatically active fragment, derivative or variant thereof.

In one embodiment, the agent is a LPLA2 enzyme comprising one or more mannose residues or one or more mannose-6-phosphate residues.

In another embodiment, the agent is a human LPLA2 enzyme or variant or derivative thereof comprising the catalytic site corresponding to amino acids 196-200 of SEQ ID NO: 1 (-A-X-S-X-G-).

In some embodiments, the human LPLA2 enzyme, variant or derivative thereof further comprises a cysteine bond corresponding to the cysteine bond between the Cys at position 65 and the Cys 89 of SEQ ID NO: 1.

In one aspect, the agent is a human LPLA2 enzyme or variant or derivative thereof comprising an amino acid sequence having at least 65%, 70%, 75%, 80%, 85%, 90%, 95% or higher identity to the amino acid sequence of a fragment of SEQ ID NO: 1 that is at least 50, 75, 100, 125, 150, 175, 200 or 225 residues in length and that comprises the catalytic site corresponding to amino acids 196-200 of SEQ ID NO: 1 (-A-X-S-X-G-).

In another aspect, the agent is a LPLA2 enzyme comprising the catalytic consensus sequence -A-X-S-X-G-. In still another aspect, the agent is a LPLA2 enzyme comprising the catalytic consensus sequence corresponding to amino acids 196-200 (-A-X-S-X-G-) of SEQ ID NO: 1. In related aspects, the LPLA2 enzyme comprises a cysteine bond corresponding to the cysteine bond between the Cys at position 65 and the Cys 89 of SEQ ID NO: 1.

The present invention further provides methods for treating a condition associated with aberrant LPLA2 activity in an individual comprising the step of administering an agent having LPLA2 enzymatic activity to said individual in an amount effective to alleviate the condition.

In one aspect, the invention provides methods for treating a patient diagnosed with a disorder characterized by the intracellular accumulation of tingible body macrophages comprising administering to the patient an effective amount of an agent having LPLA2 enzymatic activity.

In another aspect, the condition is aberrant LPLA2 enzymatic activity. In another aspect, the condition is aberrant LPLA2 mRNA transcription. In still another aspect, the condition is the accumulation of tingible body macrophages. In yet another aspect, the condition is SLE or systemic lupus erythematosus. In another aspect, the condition is drug-induced lupus.

In one embodiment, the individual has a polymorphism in the LPLA2 gene corresponding to SEQ ID NO: 1 that reduces expression or activity of LPLA2. The human genomic DNA sequence encoding human LPLA2 enzyme is set forth in SEQ ID NO: 289. The human genomic DNA sequence is 15715 bases. The human mRNA sequence is predicted to correspond to nucleotides 1 . . . 210, 3947 . . . 4103, 9576 . . . 9694, 9939 . . . 10037, 10423 . . . 10647, and 13803 . . . 15715). The coding region is predicted to correspond to nucleotides 84 . . . , 210, 3947 . . . 4103, 9576 . . . 9694, 9939 . . . 10037, 10423 . . . 10647, and 13803 . . . 14314. The human cDNA sequence encoding human LPLA2 enzyme is set forth in SEQ ID NO: 290. In some embodiments, the individual has a polymorphism at a position in the gene that encodes the catalytic site corresponding to amino acids 196-200 of SEQ ID NO: 1. In other embodiments, the individual has a polymorphism that results in truncation of the LPLA2 enzyme or loss of cationic amino acids. In yet another embodiment, the individual has a polymorphism in a regulatory control region associated with the LPLA2 gene that results in loss of LPLA2 enzyme expression.

In a further aspect, the agent having LPLA2 activity is a protein having an amino acid sequence selected from SEQ ID NOs: 1-288.

In another aspect, the agent is a mammalian LPLA2 enzyme. In one embodiment, the agent is a mammalian LPLA2 enzyme having an amino acid sequence selected from SEQ ID NOs: 1-288 or an enzymatically active fragment, derivative or variant thereof.

In yet another aspect, the agent is a human LPLA2 enzyme. In one embodiment, the agent is a human LPLA2 enzyme having the amino acid sequence in SEQ ID NO: 1 or an enzymatically active fragment, derivative or variant thereof.

In one embodiment, the agent is a human LPLA2 enzyme, variant or derivative thereof, comprising the catalytic site corresponding to amino acids 196-200 (A-X-S-X-G) of SEQ ID NO: 1. In another aspect, the agent is a LPLA2 enzyme, variant or derivative thereof comprising the catalytic consensus sequence -A-X-S-X-G-.

In some embodiments, the LPLA2 enzyme, variant or derivative further comprises a cysteine bond corresponding to the cysteine bond between the Cys at position 65 and the Cys 89 of SEQ ID NO: 1.

In one aspect, the agent is a human LPLA2 enzyme, variant or derivative thereof comprising an amino acid sequence having at least 65%, 70%, 75%, 80%, 85%, 90%, 95% or higher identity to the amino acid sequence of a fragment of SEQ ID NO: 1 that is at least 50, 75, 100, 125, 150, 175, 200 or 225 residues in length and that comprises the catalytic site corresponding to amino acids 196-200 of SEQ ID NO: 1 (-A-X-S-X-G-). In related aspects, the LPLA2 enzyme further comprises a cysteine bond corresponding to the cysteine bond between the Cys at position 65 and the Cys 89 of SEQ ID NO: 1

In one embodiment, the individual has a polymorphism that reduces expression or activity of LPLA2. In another embodiment, the individual has a polymorphism at a position corresponding to amino acids 196-200 of SEQ ID NO: 1. In a further embodiment, the individual has a polymorphism that results in truncation of the LPLA2 enzyme or loss of cationic amino acids. In yet another embodiment, the individual has a polymorphism in the regulatory control region of LPLA2 that results in loss of LPLA2 enzyme expression.

In yet another aspect, the agent is is an LPLA2 enzyme comprising one or more mannose residues.

The present invention also provides methods for screening potential therapeutics that decrease intracellular levels of tingible body macrophages comprising the step of measuring the level of intracellular tingible body macrophages in the LPLA2 null mouse model in the presence or absence of a test compound where a decrease in the level of intracellular tingible body macrophages in the presence of the test compound compared to the level of intracellular tingible body macrophages in the absence of the test compound identifies the test compound as a potential therapeutic.

The present invention also provides methods for diagnosing SLE in an individual comprising the step of determining LPLA2 enzymatic activity in a sample from an individual, wherein a LPLA2 enzymatic activity that is decreased in the individual compared to a LPLA2 enzymatic activity in a normal individual is suggestive of SLE and wherein said normal individual is known not to suffer from SLE. As used here throughout, "normal individual" refers to an individual known not to suffer from a specified disease.

The present invention further provides methods for diagnosing SLE in an individual comprising the step of detecting LPLA2 autoantibodies in a sample from an individual, wherein a detecting increased LPLA2 autoantibodies in the individual compared to detecting LPLA2 autoantibodies in a normal individual is suggestive of SLE and wherein said normal individual is known not to suffer from SLE.

The present invention provides methods for diagnosing SLE in an individual comprising the step of detecting LPLA2 enzymatic activity in the individual, wherein a LPLA2 enzymatic activity that is decreased in the individual compared to prior LPLA2 enzymatic activity in the same individual is suggestive of SLE.

The present invention also provides methods for diagnosing SLE in an individual comprising the step of detecting LPLA2 autoantibodies in the individual, wherein detecting increased LPLA2 autoantibodies in the individual compared to prior detection of LPLA2 autoantibodies in the same individual is suggestive of SLE.

The present invention provides methods for determining susceptibility to SLE in an individual comprising the step of determining LPLA2 enzymatic activity in a sample from the individual, wherein a decreased LPLA2 enzymatic activity in the individual compared to LPLA2 enzymatic activity in a normal individual indicates susceptibility to SLE.

The present invention further provides methods for determining susceptibility to SLE in an individual comprising the step of detecting LPLA2 autoantibodies in a sample from the individual, wherein detecting increased LPLA2 autoantibodies in the individual compared to detecting LPLA2 autoantibodies in a normal individual indicates susceptibility to SLE.

The present invention also provides methods for determining susceptibility to SLE in an individual comprising the step of detecting LPLA2 enzymatic activity in a sample from the individual, wherein a LPLA2 enzymatic activity that is decreased in the individual compared to prior LPLA2 enzymatic activity in the same individual is suggestive of susceptibility to SLE.

The present invention further provides methods for determining susceptibility to SLE in an individual comprising the step of detecting LPLA2 autoantibodies in a sample from the individual, wherein detecting increased LPLA2 autoantibodies in the individual compared to prior detection of LPLA2 autoantibodies in the same individual is suggestive of susceptibility to SLE.

Also provided by the present invention are methods for determining the progression of SLE in an individual comprising the step of determining LPLA2 enzymatic activity in samples from the individual taken over time, wherein a decrease in LPLA2 enzymatic activity in samples taken over time in the individual is suggestive of SLE progression.

The present invention also provides methods for determining the progression of SLE in an individual comprising the step of detecting LPLA2 autoantibodies in samples from the individual taken over time, wherein an increase in LPLA2 autoantibodies in the samples taken over time in the individual is suggestive of SLE progression.

In various embodiments of methods of the invention, LPLA2 mRNA levels and/or LPLA2 protein levels are used to measure LPLA2 enzymatic activity in the sample.

In various aspects of the methods, the sample is a bodily fluid, tissue and/or organ of said individual.

In other aspects of the methods, the tissue is a spleen specimen.

In another aspect of the methods, the fluid is serum or plasma.

The foregoing summary is not intended to define every aspect of the invention, and additional embodiments are described in other sections, such as the Detailed Description. The entire document is intended to be related as a unified disclosure, and it should be understood that all possible combinations of features described herein may be contemplated, even if the combination of features are not found together in the same sentence, or paragraph, or section of this document.

Moreover, the invention includes any one or all embodiments of the invention that are narrower in scope in any way than the variations defined by specific paragraphs herein. For example, where certain aspects of the invention are described as a genus, it should be understood that every member of a genus is, individually, an embodiment of the invention, and that combinations of two or more members of the genus are embodiments of the invention.

BRIEF DESCRIPTION OF THE DRAWINGS

FIG. 1C. Comparison of deduced amino acid sequences of human, mouse, and bovine LPLA2s. Position 1 refers to the first amino acid residue of the predicted coding region in human and mouse. The dashed boxes indicate the N-glycosylation site consensus motifs, and the solid box indicates a lipase motif. The shaded boxes indicate the amino acids Ser, Asp, and His composing the catalytic triad. The axial line is a putative signal peptide cleavage site. Asterisks denote identical amino acids among these three species.

DETAILED DESCRIPTION OF INVENTION

Figure 1A:
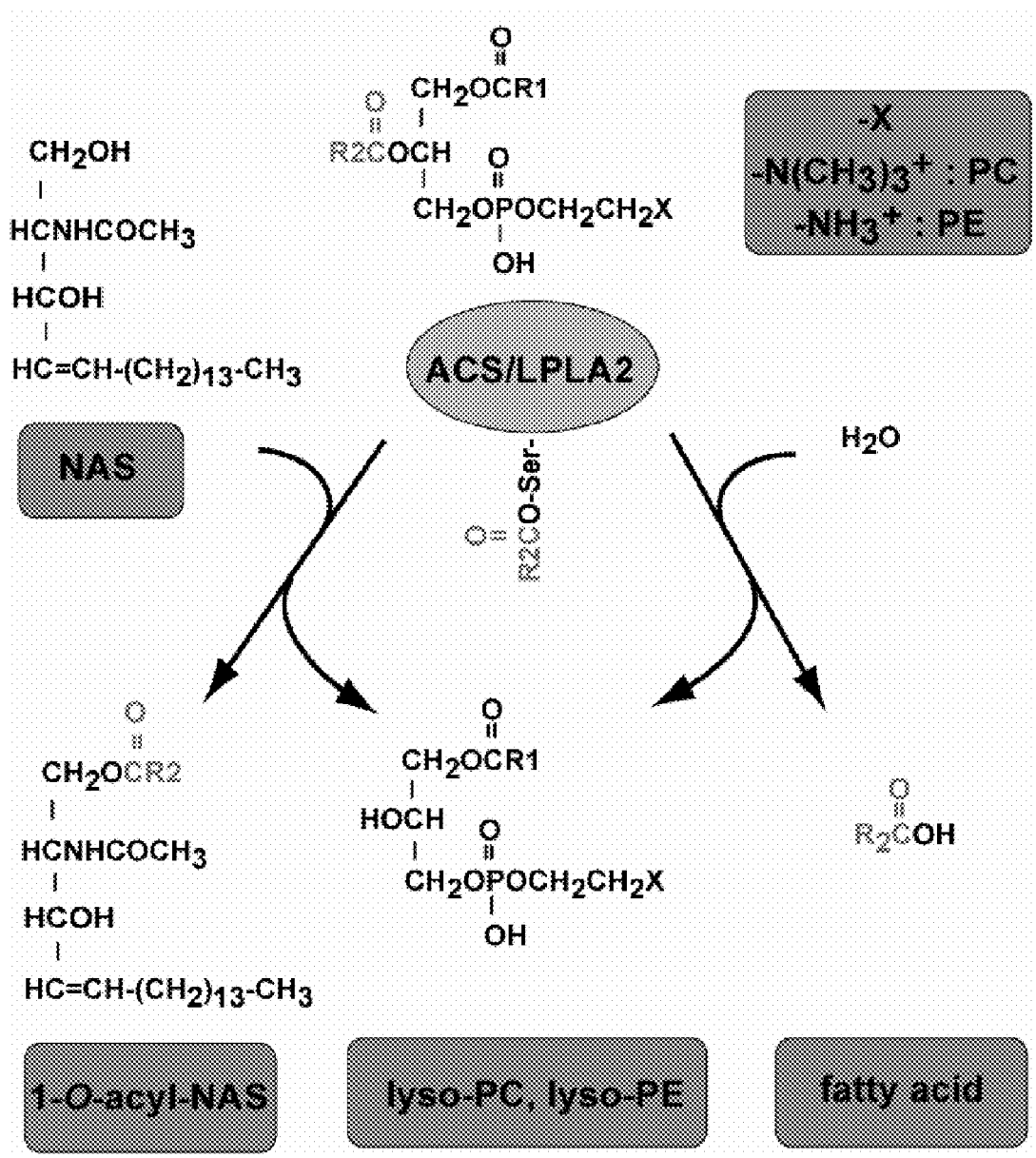
FIG. 1A. Pathways for lysosomal phospholipase A2. In the presence of an acceptor such as ceramide (N-acetylsphingosine (NAS)) the enzyme behaves as a transacylaselphosphlipase A2, akin to LCAT. With only water as an acceptor, LPLA2 behaves as a traditional phospholipase A2.

Systemic lupus erythematosus remains a poorly understood autoimmune disorder. Much progress has been made in the last twenty years in identifying genetic models that resemble the lupus phenotype. However, this previous work has not readily been translated into new diagnostic tools for better defining lupus patients or into new therapeutics for the treatment of these unfortunate patients. The identification herein of a secreted, lysosomal protein where the loss of function plays an important role in SLE has several important implications. First, as a secreted protein, serum LPLA2 activity may be a valuable marker of disease activity. Second, the existence of autoantibodies to LPLA2 may be mechanistically important in a subset of patients with SLE. Third, if a deficiency, inherited or acquired, in LPLA2 underlies the development of SLE in a subset of patients, then the protein itself may be a useful therapeutic agent. Mannose-terminated lysosomal proteins are the basis for enzyme replacement strategies for a growing list of lysosomal storage diseases. These include type I Gaucher disease, Fabry disease and Hunter syndrome. Previous studies demonstrating the avid binding, incorporation, and trafficking of LPLA2 in macrophages suggest that this strategy might be applied to SLE as well.

The present invention is directed to methods of treating disorders characterized by the intracellular accumulation of tingible body macrophages by administering compositions comprising LPLA2, including fragments, variants or derivatives thereof, compositions that augment, increase or otherwise stimulate the activity of LPLA2, and compositions that increase or otherwise stimulate the expression of LPLA2. Such compositions may be used for catabolizing phospholipids and/or increasing digestion or clearance of apoptotic bodies in mammalian tissue and/or reducing accumulation of tangible body macrophages in mammalian tissue. It is therefore contemplated that such compositions will be useful for ameliorating signs and symptoms of a disorder that involves the accumulation of tingible body macrophages, or reducing complications experienced by patients suffering from the disorder. Disorders characterized by intracellular accumulation of tangible body macrophages include systemic lupus erythematosis, drug-induced lupus, neonatal lupus, and cutaneous lupus, rheumatoid arthritis, In a related aspect, the invention provides methods for identifying additional agents that decrease intracellular levels of tingible body macrophages through augmenting, increasing or otherwise stimulating the activity of LPLA2, or increasing or otherwise stimulating the expression of LPLA2.

In yet another related aspect, the invention provides methods for diagnosis of, or the determination of the susceptibility to, SLE or systemic lupus erythematosus by assaying body fluid or tissue samples from patients for the presence of LPLA2 autoantibodies or for reduced LPLA2 expression or activity. Similar methods are provided for monitoring progression of SLE or systemic lupus erythematosus.

The present application demonstrates the involvement of a particular lysosomal phospholipase A2 in the digestion and clearance of apoptotic bodies. Mice lacking LPLA2 exhibit glomerulonephritis with proteinuria, renal failure and associated with immune complex deposition that includes C3, C1q, and Ig,. Macrophages in the spleen of LPLA2 null mice display very high levels of TUNEL positive, tingible bodies representing endocytosed but undegraded apoptotic bodies. Isolated peritoneal macrophages from LPLA2−/− mice are characterized by the inability to digest apoptotic thymocytes but normal capacity to bind and endocytose apoptotic thymocytes. The finding that macrophages from LPLA2 null mice fail to digest engulfed apoptotic bodies indicates that this impairment is due to the absence of LPLA2. Treatment with exogenous LPLA2 is expected to increase digestion and clearance of apoptotic bodies, and to reduce accumulation of tingible body macrophages.

The data also show that cationic amphiphilic drugs inhibit LPLA2 activity and result in cellular phospholipidosis. The mechanism underlying this inhibition appears to be interference with the electrostatic interactions between LPLA2 and anionic lipid membranes.

Finally, the data also demonstrate that mRNA expression of LPLA2 is decreased in the microdissected glomeruli of patients with lupus, compared to the glomeruli of normal controls and glomeruli of patients with other glomerular diseases resulting from diabetes, hypertensive nephrosclerosis, minimal change disease, and IgA nephropathy.

Tingible Body Macrophages

Tingible body macrophages are large, mononuclear phagocytic cells found in the germinal centers of lymphatic tissue (Smith et al., Developmental Immunology 6(3-4): 285-294, 1998). These macrophages contain many phagocytized, apoptotic cells (referred to as tingible bodies) in various states of degradation (Swartzendruber and Congdon, Journal of Cell Biology 19: 641-646, 1963; Tabe et al, Acta Otolaryngologica Supplement 523: 64-67, 1996). These cells have been referred to as type-1 phagocytes. (Kotani et al., Acta Anatomica (Basel) 99(4): 391-402, 1977)

These macrophages sometimes range in size from 20-30 μm or larger and contain a variable number of inclusions. The inclusions represent not only nuclear, but also cytoplasmic debris in varying stages of lysis. Various cell types form the debris constituting tingible bodies. For example, plasmacyte and lymphocyte debris, granulocytes as well as phagocytized erythrocytes have been identified in macrophages from germinal centers. (Swartzenbruber et al., J. Cell Biology, 19:641-646, 1963)

One of the earliest changes in apoptosis is the exposure of phosphatidylserine (PS) and phosphatidylethanolamine (PE) on the outer leaflet of the plasma membrane. Tingible body macrophages strongly express milk fat globule epidermal growth factor-8 (MFG-E8) which binds to apoptotic cells by recognizing PS and enhances the engulfment of apoptotic cells. Knock-out mice lacking expression of MFG-E8 carry many unengulfed apoptotic cells in the germinal centers of the spleen, and develop a lupus-like autoimmune disease (Hanayama et al., Science 304(5674): 1147-1150, 2004 and Current Directions in Autoimmunity 9: 162-172, 2006). Apoptotic bodies are characterized by intact plasma membranes and expression of PS on the outer leaflet of the plasma membrane.

Increased accumulation of tangible body macrophages is found lymph node germinal centers of rheumatoid arthritis patients (Imai et al., Acta Pathol Jpn. 1989 February;39(2): 127-34).

SLE and Clearance of Apoptotic Cells

The failed or reduced clearance of apoptotic cells has emerged as one of the most popular hypotheses for the development of autoimmunity (Erwig et al., Am J Pathol 171: 2-8, 2007; Savill et al., Nature 407: 784-788, 2000; Tanaka et al., Curr Med Chem 14: 2892-2897, 2007). The clearance of apoptotic cells by phagocytosis can be divided into four distinct steps. These steps include the recruitment of phagocytes to the sites where apoptotic cells are located, the recognition of apoptotic cells through receptors and bridging molecules, the endocytosis of apoptotic bodies into phagocytes, and the digestion of endocytosed cell bodies. While a great deal of progress has been made in delineating the mechanisms associated with recognition and endocytosis, very little has been elucidated with regard to the digestion of apoptotic bodies that have been endocytosed.

There are three characteristic features of lupus that may reflect the impairment of apoptotic cell clearance. These pathogenomic features include the lupus erythematosus (LE) cell (Hargraves et al., Mayo Clin Proc 23: 25-28, 1948), hematoxylin bodies (Wilson et al, Am J Med Sci 241: 31-43, 1961), and tingible body macrophages (Baumann et al., Arthritis Rheum 46: 191-201, 2002). What little that has been published on the ultrastructural characterization of these pathological abnormalities suggests that they represent the persistent presence of apoptotic bodies ingested by phagocytic cells in the bone marrow, kidney and lung, and lymphoid tissues respectively (Ruiz-Arguelles et al., Scand J Clin Lab Invest Suppl 235: 31-37, 2001; Swartzendruber et al., J Cell Biol 19: 641-646, 1963). Baumann et al. (2002) have reported that apoptotic cells are not properly cleared by tingible body macrophages of the germinal centers in a sub-group of patients with SLE. (Baumann et al., Arthritis and Rheumatism 46(1): 191-201, 2002).

SLE includes systemic lupus erythematosus or any other autoimmune disease displaying SLE symptoms or accumulation of tingible body macrophages. Autoantibodies play a role in disease development in SLE. (Rahman, Rheumatology 43(11):1326-1336, 2004; Ehrenstein, Rheumatology 38: 691-693, 1999). Targets of autoantibodies in systemic lupus erythematosus include nuclear and cytoplasmic macromolecules, lipid components and plasma proteins. Autoantibodies are involved in disease development either by forming immune complexes that lodge in target organs, disrupting normal organ function, or by cross-reacting with targeted antigens and damaging tissue. The most frequently associated autoantibodies in systemic lupus erythematosus include antibodies to Smith (a ribonucleoprotein), and antibodies to nucleosomes, histones, and double stranded (ds) DNA. Anti-ds DNA antibodies are the most frequently detected antibodies in SLE. Titers of dsDNA antibodies can be used to diagnose systemic lupus and evaluate disease activity.

Systemic lupus erythematosus is a multisystem disease. The most common initial signs of the disease are fatigue, fever, and muscle and joint pain. Muscle pain (myalgia), joint pain (arthralgia) and arthritis are common with the new onset of lupus and with subsequent flare-ups. The muscles themselves can sometimes become inflamed and very painful contributing to weakness and fatigue. The most frequent joints involved in lupus arthritis are those of the hand, knees, and wrists. Complications caused by reduced blood flow to a joint can cause death of the bone in the joint (avascular necrosis). Avascular necrosis occurs most commonly in the hips and knees.

Skin symptoms occur in more than 90% of patients with lupus and can include many different types of rashes. The classic lupus rash is a redness on the cheeks (malar blush) often brought on by sun exposure. Discoid lupus with red skin patches on the skin and scaliness is a characteristic rash that can lead to scarring. It usually occurs on the face and scalp and can lead to loss of scalp hair (alopecia).

Kidney complications, glomerulonephritis due to deposition of immune complexes in the kidney, are observed in more than half of all patients with lupus. Severe kidney disease often requires immunosuppressive therapy. More than 50% of patients with lupus have lung complications. Inflammation of the lining of the lung (pleurisy) is common. Pleural effusions can occur as well. Inflammation of the arteries (vasculitis) can occur, as well as inflammation around the heart (pericarditis). Patients with lupus are also more predisposed to develop atherosclerosis.

Nervous system involvement occurs in about 15% of patients with lupus. Potential symptoms include seizures, nerve paralysis, severe depression, psychosis, and strokes. Spinal cord inflammation in lupus is rare but can cause paralysis. About half of patients with lupus have anemia and/or thrombocytopenia and/or leukopenia. Some lupus patients are predisposed to developing blood clots. This is most likely to occur in patients who have antiphospholipid antibodies. Inflammation or infection of the intestines can occur, due to a blood clot or inflammation of blood vessels in the intestines. Some patients experience intermittent interruptions in blood supply to the hand (Raynaud's syndrome), which manifests as whiteness, blueness and pain in the fingers.

Drug-induced lupus (DIL) is a disorder with symptoms similar to systemic lupus erythematosus, which is induced by chronic use of certain drugs. Drug-induced lupus is a well-known entity, accounting for 5-10% of all lupus syndromes has been reported as a side-effect of long-term therapy with over 40 medications. (Rubin, Toxicology 209(2):135-47, 2005; Perez-Garcia et al., Rheumatology, 45(1):114-116, 2006). Its clinical and laboratory features are similar to systemic lupus erythematosus, except that patients generally recover after the offending medication is discontinued. Although over 40 medications are known to be associated with drug-induced lupus, the three that report the highest numbers are: procainamide (brand name Pronestyl, used to treat heart arrythmias), hydralazine (brand name Apresoline, used to tread hypertension) and quinidine (brand name Quinaglute, used to treat heart arrythmias). (Hofstra, Drug Metab Rev 26 (3):485-505, 1994; Uetrecht et al. Chem Res Toxicol 1 (1): 74-8, 1998). Drugs that cause drug-induced lupus include Acebutolol, Amiodarone, Bupropion, Captopril, Carbamazepine, Chlorpromazine, Diltiazem, Docetaxel, Ethosuximide, Gemfibrozil, Glyburide, Gold salt, Griseofulvin, Hydantoins, Hydralazine, hydroxychloroquine, Interferons, Interleukins, Isoniazid, Leuprolide acetate, Lithium, Lovastatin, Mephenytoin, Methyldopa, Minocycline, Nitrofurantoin, Olanzapine, Ophthalmic timolol, Oral contraceptives, Penicillamine, Phenytoin, Practolol, Procainamide, Propylthiouracil, Quinidine, Reserpine, Rifampin, Simvastatin, Sulfasalazine, Tetracycline, Ticlopidine, Tiotropium bromide inhaler, Trimethadione, Tumor necrosis factor, Valproate, or Voriconazole. Drugs that cause flares of systemic lupus erythematosus are as follows: Cimetidine, Hydralazine, Hydrochlorothiazide, Mesantoin, P-Aminobenzoic acid (PABA), Penicillin, Phenylbutazone, Sulfonamides, or Terbinafine.

Lysosomal Phospholipase A2 and the Phospholipase Superfamily

The present section provides a general description of the family of phospholipases, and LPLA2 enzymes specifically.

The phospholipase A2 superfamily is comprised of a broad range of enzymes that share the ability to hydrolyze the sn-2 ester bond of phospholipids. The products of this reaction, free fatty acid and lysophospholipid, have important biological roles. The former is not only an important source of cellular energy, but is also the substrate for additional cellular messengers in the form of arachidonate metabolites. The latter products play signaling roles in addition to having important effects on membrane remodeling and membrane perturbation. Historically the PLA2s were thought to be small, secreted enzymes characterized by having a catalytic histidine, calcium dependence and being disulfide rich. The family of enzymes greatly expanded with the discovery of cytosolic PLA2 activity assignable to a protein that lacked disulfide bonds and characterized by presence of a catalytic serine (Gronich et al., J Biol Chem 263: 16645-16651, 1988). Currently there are fifteen groups of phospholipase A2s. Groups I, II, II, V, IX, X, and XI utilize a catalytic histidine and are of small molecular weight (13-15 kDa). Groups IV, VI, VII, and VIII utilize a nucleophilic serine and have little or no Ca2+ requirement for catalysis. The molecular weights are larger (26-114 kDa). Many members of these latter groups have C2 domains, are members of the α/βfold hydrolase proteins, and may contain a required Ser/His/Asp triad for activity.

Lysosomal phospholipase A2 (LPLA2, LLPL, LYPLA3), also known as 1-O-acylceramide synthase, was recently recognized as the first member of a new group XV of PLA2s (Schaloske et al., Biochim Biophys Acta 1761: 1246-1259, 2006). LPLA2 is a single-chain, mannose-rich glycoprotein having a molecular mass of about 40 kDa. LPLA2 has both lipase and transacylase activities, and an acidic pH optimum. It is specific for the phospholipids phosphatidylcholine (PC) and phosphatidylethanolamine (PE). The protein is selectively and highly expressed in alveolar macrophages but is also present to a lesser degree in peritoneal macrophages, peripheral blood monocytes, or other tissues. Other macrophage-associated phospholipase A2s do not show a comparable distribution.

LPLA2 is secreted from macrophages and mast cells in response to agonists. LPLA2 is recognized by cellular mannose receptors and is reincorporated and trafficked back to the lysosome when exogenously administered. The secretion of LPLA2 results in the formation of bioactive lipid ligands with known effects on lymphocyte recruitment, proliferation, and cytokine production.

In 1996, the existence of a novel pathway for ceramide metabolism was reported (Abe, A., Shayman, J. A., and Radin, N. S. J Biol Chem 271, 14383-14389, 1996). This pathway results in the formation of a highly lipophilic metabolite of ceramide, 1-O-acylceramide (FIG. 1A). Under this reaction, a fatty acid from the sn-2 position of phosphatidylcholine or phosphatidylethanolamine is transferred to the C-1 hydroxyl group of ceramide. Upon purification of the enzyme, it was determined that either ceramide or water could serve as acceptors for sn-2 fatty acid (Abe, A., and Shayman, J. A. J Biol Chem 273, 8467-8474, 1998). In the presence of ceramide, LPLA2 catalyzes the formation of 1-O-acylceramide by transacylation of fatty acids from the sn-2 position of phosphatidylcholine or phosphatidylethanolamine. When water serves as the acceptor, in the absence of ceramide or other alcohols, the enzyme acts as a traditional phospholipase A2. Two characteristics of this phospholipase A2 immediately became apparent. First, the enzyme displayed acidic pH optimum, about 4.5; second, the enzyme localized to lysosomes.

Figure 1B:
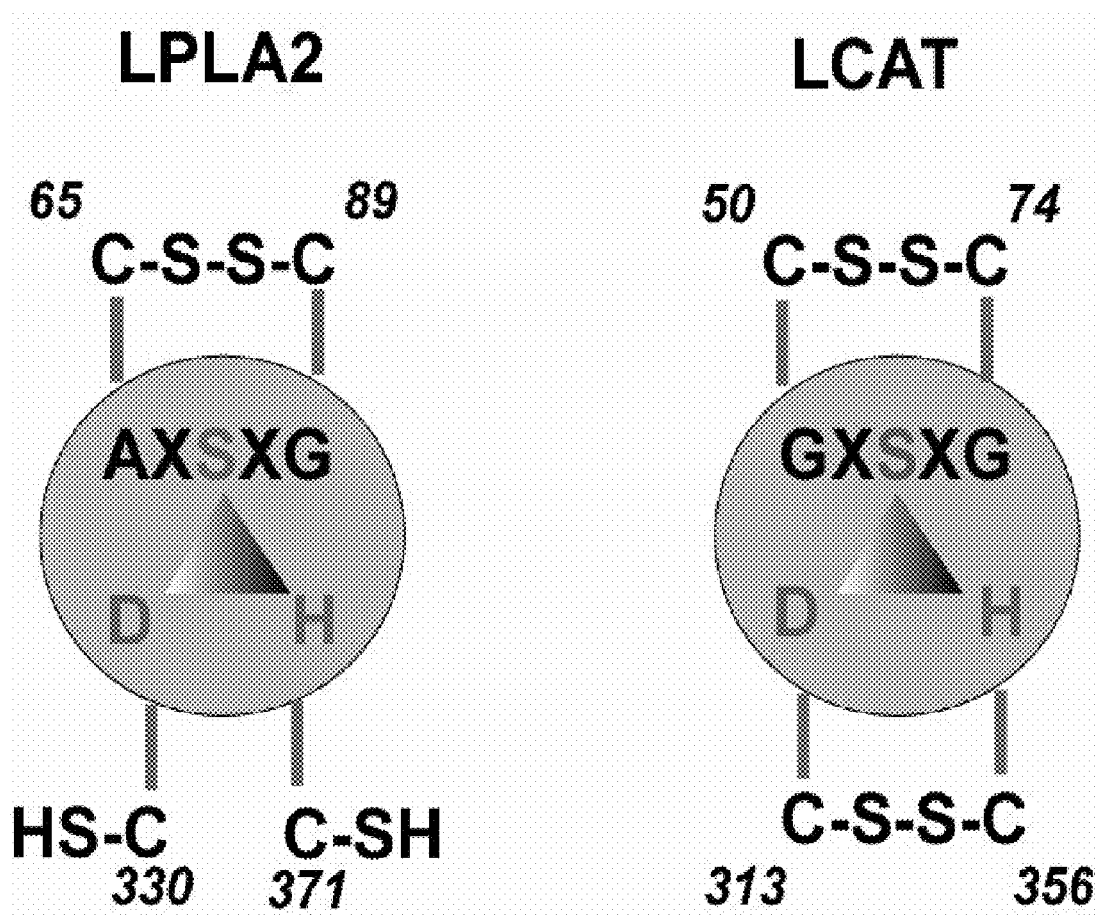
FIG. 1B. Comparison of the catalytic triads and disulfide linkages seen in LPLA2 and LCAT.

Based on the enzyme purification, several partial amino acid sequences of LPLA2 were determined and the full length of coding and full length amino acid sequences determined (Hiraoka et al., J Biol Chem 277, 10090-10099, 2002). The expressed protein was confirmed to have both phospholipase A2 and transacylase activities. Analysis of the coding sequence revealed LPLA2 is 49% identical at the amino acid level with lecithin cholesterol acyltransferase (LCAT). Most of the identity was localized to the catalytic domain (FIG. 1B). Both LCAT and LPLA2 colocalized to 16q22 where they are contiguously placed, consistent with one gene arising from a duplication event. Phylogenetic analysis revealed that both genes were derived from diacylglycerol acyltransferase and that LPLA2 is ancestral to LCAT.

The sequence of human LPLA2 is set forth in SEQ ID NO: 1. A more detailed analysis of the catalytic domain revealed that LPLA2 contains a consensus sequence, -A-X-S-X-G- (amino acids 196-200 of SEQ ID NO: 1), present in other phospholipase A2s and acylhydrolases. The serine is part of a catalytic triad composed of an asparagine and histidine residue in close approximation and serving to convert the serine into a strong nucleophile. Site directed mutagenesis of the triad amino acids eliminated the intrinsic phospholipase and transacylase activities of LPLA2. Additional analysis revealed the presence of a single disulfide bridge between Cys65 and Cys89 (Hiraoka, M., Abe, A., and Shayman, J. A. J Lipid Res 46, 2441-2447, 2005). More recently, the sn-I versus sn-2 specificity of the enzyme has been assessed. LPLA2 displays high specificity toward phospholipids containing arachidonate in the sn-2 position. However, both sn-I and sn-2 hydrolase activities are seen when other fatty acyl substitutions are present (Abe, A., Hiraoka, M., and Shayman, J. A. J Lipid Res 47, 2268-2279, 2006). Other lipophilic alcohols besides ceramide can serve as acceptors for the fatty acid via the transacylation activity (Abe, A., Hiraoka, M., and Shayman, J. A. J Lipid Res 48, 2255-2263, 2007).

The divalent cations Ca2+ and Mg2+ enhance, but are not required for, LPLA2 transacylase activity. LPLA2 is neither activated nor inhibited in the presence of ATP or thiol reagents such as dithiothreitol and NEM. Thus the enzyme differs from groups I, II, and III phospholipase A2s, which are highly sensitive to such reagents. The phospholipase A2 inhibitors bromoenollactone (BEL) and nonadecyltetraenyl trifluoromethyl ketone (AACOF3) do not inhibit the enzyme activity.

LPLA2 is a high mannose-type glycoprotein, suggesting that the released enzyme might be reincorporated into macrophages via a mannose or mannose-6- phosphate receptor. Recombinant glycosylated mouse LPLA2 produced by HEK293 cells was applied to LPLA2-deficient (LPLA2−/−) mouse alveolar macrophages. The uptake of exogenous LPLA2 into LPLA2−/− alveolar macrophages occurred in a concentration-dependent manner and colocalized with the lysosomal marker, Lamp-1. (Abe et al. J. Immunol, 181(11): 7873-81, 2008) This uptake was significantly suppressed in the presence of alpha-methyl-mannoside but not in the presence of mannose 6-phosphate. Thus, the predominant pathway for uptake of exogenous LPLA2 is via the mannose receptor. (Abe et al., J. Immunol, 181(11):7873-81, 2008).

LPLA2 Fragments, Variants and Derivatives

LPLA2 that are useful according to the methods of the invention may comprise an amino acid sequence of any one of SEQ ID NOs: 1-288, or biologically active fragments or variants or derivatives thereof. Compositions comprising such LPLA2, fragments, variants or derivatives are used in the treatment of disorders involving impaired clearance of apoptotic bodies and/or accumulation of tingible body macrophages. Polynucleotides encoding the LPLA2, fragments or variants thereof, are also useful in the present invention, e.g. for gene therapy purposes or recombinant production of the protein.

LPLA2 proteins include any mammalian protein that comprises the amino acid sequences of SEQ ID NOs: 1-288, a fragment of SEQ ID NOs: 1-288, or a variant or conservative substitution variant of a protein of SEQ ID NOs: 1-288, or a derivative thereof that retains the desired biological activity. In certain aspects, the LPLA2 protein is derived from any natural source, e.g., a mammalian origin such as human (SEQ ID NO: 1), bovine, murine (e.g., of these sequences are depicted in FIG. 1C and Hiraoka et al., J Biol Chem 277, 10090-9, 2002), or alternatively, it is produced synthetically or through recombinant methods known to those of skill in the art. For the purposes of treating disorders associated with accumulation of tingible body macrophages, e.g., SLE or systemic lupus erythematosus, the desired retained biological activity is a catabolic effect on phospholipids, and/or improved clearance of apoptotic bodies and/or reduced accumulation of tingible body macrophages.

A. Fragments and Variants

Truncation of amino acids at the N-terminus or C-terminus of any of SEQ ID NO: 1-288 may provide fragments that retains the desired biological activity. Fragments of at least 10, 20, 30, 40, 50, 60, 70, 80, 90, 100, 110, 120, 130, 140, or 150 consecutive amino acids are contemplated. Such fragments preferably comprise the catalytic consensus sequence, -A-X-S-X-G-, corresponding to amino acids 196-200 of SEQ ID NO: 1. Such fragments may also include a cysteine bond corresponding to the cysteine bond between the Cys at position 65 and the Cys 89 of SEQ ID NO: 1.

The term "variant" is intended to mean a protein derived from the native protein by deletion or addition of one or more amino acids at one or more sites in the native protein and/or substitution of one or more amino acids at one or more sites in the native protein. Variants are readily made by any of the variety of means known in the art, including through recombinant production. Polynucleotides encoding variants may be made, e.g. through site-directed mutagenesis of polynucleotides encoding LPLA2, or through direct synthesis of the encoding polynucleotide sequence.

Biologically active variants of a native LPLA2 protein of the invention will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the native protein as determined by sequence alignment programs. A biologically active variant of a protein of the invention may differ from that protein by as few as 1-15 amino acid residues, as few as 1-10, such as 6-10, as few as 5, as few as 4, 3, 2 or even 1 amino acid residue. Biologically active variants alternatively are encoded by a polynucleotide that hybridizes under stringent conditions to the complement of a polynucleotide that encodes SEQ ID NO: 1. Highly stringent conditions include hybridization and wash conditions of relatively low ionic strength and high temperature. Exemplary highly stringent wash conditions comprise washing in 0.1×SSC at 65-68° C. Exemplary moderately stringent wash conditions comprise washing in 1×SSC at 55° C.

As another example, conservative substitution or non-conservative substitution, insertion or deletion of amino acid residues of any of SEQ ID NO: 1-288 may produce variants that retain the desired biological activity and/or retain three-dimensional conformation structure of the protein of SEQ ID NOs: 1-288. Such variants preferably comprise the catalytic consensus sequence, -A-X-S-X-G-. Such variants may also include a cysteine bond corresponding to the cysteine bond between the Cys at position 65 and the Cys 89 of SEQ ID NO: 1.

The term "conservative substitution" as used herein denotes the replacement of an amino acid residue by another, biologically similar residue with respect to hydrophobicity, hydrophilicity, cationic charge, anionic charge, shape, polarity and the like. Examples of conservative substitutions include the substitution of one hydrophobic residue such as isoleucine, valine, leucine, alanine, cysteine, glycine, phenylalanine, proline, tryptophan, tyrosine, norleucine or methionine for another, or the substitution of one polar residue for another, such as the substitution of arginine for lysine, glutamic acid for aspartic acid, or glutamine for asparagine, and the like. Neutral hydrophilic amino acids which are substituted for one another include asparagine, glutamine, serine and threonine. The term "conservative substitution" also includes the use of a substituted or modified amino acid in place of an unsubstituted parent amino acid provided that antibodies raised to the substituted polypeptide also immunoreact with the unsubstituted polypeptide. By "substituted" or "modified" the present invention includes those amino acids that have been altered or modified from naturally occurring amino acids.

As such, it should be understood that in the context of the present invention, a conservative substitution is recognized in the art as a substitution of one amino acid for another amino acid that has similar properties. Exemplary conservative substitutions are set out in e.g., Alternatively, conservative amino acids are grouped as described in Lehninger, (Biochemistry, Second Edition; Worth Publishers, Inc. N.Y.:N.Y. (1975), pp.71-77). Those of skill in the art are aware of numerous tables that indicate specific conservative substitutions. One exemplary such table is provided below:

| Table of Exemplary Conservative Substitutions | |
|---|---|
| Original Residue | Exemplary Substitution |
| Ala (A) | Val, Leu, Ile |
| Arg (R) | Lys, Gln, Asn |
| Asn (N) | Gln, His, Lys, Arg |
| Asp (D) | Glu |
| Cys (C) | Ser |
| Gln (Q) | Asn |
| Glu (E) | Asp |
| His (H) | Asn, Gln, Lys, Arg |
| Ile (I) | Leu, Val, Met, Ala, Phe, |
| Leu (L) | Ile, Val, Met, Ala, Phe |
| Lys (K) | Arg, Gln, Asn |
| Met (M) | Leu, Phe, Ile |
| Phe (F) | Leu, Val, Ile, Ala |
| Pro (P) | Gly |
| Ser (S) | Thr |
| Thr (T) | Ser |

| Table of Exemplary Conservative Substitutions | |
|---|---|
| Original Residue | Exemplary Substitution |
| Trp (W) | Tyr |
| Tyr (Y) | Trp, Phe, Thr, Ser |
| Val (V) | Ile, Leu, Met, Phe, Ala |

Any variant of a protein of SEQ ID NOs: 1-288 that retains most or all of the catalytic domain of the LPLA2 of SEQ ID NOs: 1-288 is contemplated to be useful in the methods of the present invention. As described above, the catalytic domain of LPLA2 contains the consensus sequence, -A-X-S-X-G-, present in other phospholipase A2s and acylhydrolases. The serine is part of a catalytic triad composed of an asparagine and histidine residue in close approximation and serving to convert the serine into a strong nucleophile. One approach to making variants is to begin with conservative substitutions within or near the catalytic domain, while retaining the consensus catalytic sequence, followed by conservative substitutions or non-conservative substitutions, insertions or deletions outside of the catalytic domain. LPLA2 of SEQ ID NO: 1 has 50% homology to cholesterol lecithin acyltransferase (LCAT), and the majority of this homology is within the catalytic domain. Thus, it is contemplated that those of skill in the art may choose to produce variants of SEQ ID NO: 1 in which the catalytic domain of SEQ ID NO: 1 is replaced by the catalytic domain of an LCAT (Hiraoka et a., J Biol Chem 277, 10090-9, 2002), as long as such a variant retains its property of catalyzing phospholipid breakdown. Such activities are readily assessed as described herein below.

In addition, rational drug design is used to produce structural variants of the LPLA2 proteins and thus provide additional compositions for use in the methods contemplated herein. By creating such variants, the skilled worker can fashion LPLA2-derived proteins which are more active or stable than the natural molecules which have different susceptibility to alteration or which may affect the function of various other molecules. In one approach, it is desirable to generate a three-dimensional structure for LPLA2-derived protein of interest or a fragment thereof e.g., by x-ray crystallography, computer modeling or by a combination of both approaches. An alternative approach, "alanine scan," involves systematic replacement of residues throughout the protein with alanine, followed by determining the resulting effect on function.

Furthermore, nonpeptide variants of LPLA2-derived proteins that provide a stabilized structure or lessened biodegradation, are also contemplated. Peptide mimetic variants are prepared based on the underlying LPLA2 protein structure by replacing one or more amino acid residues of the protein of interest by nonpeptide moieties. In one aspect, the nonpeptide moieties permit the peptide to retain its natural confirmation, or stabilize a bioactive confirmation. One example of methods for preparation of nonpeptide mimetic variants from peptides is described in Nachman et a., Regul. Pept. 57:359-370 (1995). "Peptide" as used herein embraces all of the foregoing.

B. Derivatives

In addition to the basic amino acid structure of the proteins, it is contemplated that the LPLA2 proteins will be modified to enhance their uptake, decrease toxicity, increase circulatory time, or modify biodistribution of the LPLA2 proteins. For example, any modification that facilitates the greater uptake of LPLA2 compositions by macrophages, e.g. modifications that increase mannose residues, are contemplated. Mannose content of LPLA2 can be increased, for example, by chemical conjugation of mannose, by treatment with enzymes that expose or add mannose to glycosylation sites, or by modification of recombinant production methods to favor high mannose content of the resulting glycoprotein. Compositions of LPLA2 with high mannose content can alternatively be prepared by affinity purification using a matrix coupled to mannose binding protein, e.g. a mannose receptor, a mannose-binding lectin, and the like.

The compounds of the invention may also be covalently or noncovalently associated with a carrier molecule, such as a linear polymer (e.g., polyethylene glycol, polylysine, dextran, etc.), a branched-chain polymer (see, for example, U.S. Pat. Nos. 4,289,872; 5,229,490; WO 93/21259); a lipid; a cholesterol group (such as a steroid); or a carbohydrate or oligosaccharide. Other possible carriers include antibody moieties, and in particular constant regions derived from an antibody. Still other possible carriers include one or more water soluble polymer attachments such as polyoxyethylene glycol, or polypropylene glycol as described U.S. Pat. Nos: 4,640,835, 4,496,689, 4,301,144, 4,670,417, 4,791,192 and 4,179,337. Still other useful polymers known in the art include monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide copolymer, polyoxyethylated polyols (e.g., glycerol) and polyvinyl alcohol, as well as mixtures of these polymers.

For example, an Fc region can be fused to the N-terminus or C-terminus (or both) of the LPLA2 protein, fragment or variant. Multiple vehicles, as exemplified herein, may also be used; e.g., an Fc at a terminus and a PEG group at the other terminus or a side chain.

In various embodiments, the Fc component is either a native Fc or an Fc variant. By way of example and without limitation, the Fc component is an Fc region of the human immunoglobulin IGGI heavy chain or a biologically active fragment, derivative, or dimer thereof, see Ellison, J. W. et al., Nucleic Acids Res. 10:4071-4079 (1982). It is understood, however, that an Fc region for use in the invention may be derived from an IgG, IgA, IgM, IgE or IgD from any species. Native Fc domains are made up of monomeric polypeptides that may be linked into dimeric or multimeric forms by covalent (i.e., disulfide bonds) and/or non-covalent association. The number of intermolecular disulfide bonds between monomeric subunits of native Fc molecules ranges from 1 to 4 depending on class (e.g., IgG, IgA, IgE) or subclass (e.g., IgG1, IgG2, IgG3, IgA1, IgA2). One example of a native Fc is a disulfide-bonded dimer resulting from papain digestion of an IgG (see Ellison et al. (1982), Nucleic Acids Res. 10: 4071-9).

Various water-soluble polymers have been shown to modify biodistribution, improve the mode of cellular uptake, change the permeability through physiological barriers, and modify the rate of clearance from the body. (Greenwald et al., Crit Rev Therap Drug Carrier Syst. 2000;17:101-161; Kopecek et al., J Controlled Release., 74:147-158, 2001). To achieve either a targeting or sustained-release effect, water-soluble polymers have been synthesized that contain drug moieties as terminal groups, as part of the backbone, or as pendent groups on the polymer chain.

Polyethylene glycol (PEG), has been widely used as a drug carrier, given its high degree of biocompatibility and ease of modification. Harris et a., Clin Pharmacokinet. 2001;40(7): 539-51 Attachment to various drugs, proteins, and liposomes has been shown to improve residence time and decrease toxicity. (Greenwald et al., Crit Rev Therap Drug Carrier Syst. 2000;17:101-161; Zalipsky et al., Bioconjug Chem. 1997;8: 111-118). In one aspect, PEG is coupled to active agents through the hydroxyl groups at the ends of the chain and via other chemical methods; however, PEG itself is limited to at most two active agents per molecule. In a different approach, copolymers of PEG and amino acids were explored as biomaterials which retain the biocompatibility properties of PEG, but which have the added advantage of numerous attachment points per molecule (providing greater drug loading), and which could be synthetically designed to suit a variety of applications (Nathan et al., Macromolecules. 1992; 25:4476-4484; Nathan et al., . Bioconj Chem. 1993;4:54-62).

Those of skill in the art are aware of PEGylation techniques for the effective modification of drugs. For example, drug delivery polymers that consist of alternating polymers of PEG and tri-functional monomers such as lysine have been used by VectraMed (Plainsboro, N.J.). The PEG chains (typically 2000 daltons or less) are linked to the $\alpha$- and $\epsilon$-amino groups of lysine through stable urethane linkages. Such copolymers retain the desirable properties of PEG, while providing reactive pendent groups (the carboxylic acid groups of lysine) at strictly controlled and predetermined intervals along the polymer chain. In one aspect, the reactive pendent groups are used for derivatization, cross-linking, or conjugation with other molecules. These polymers are useful in producing stable, long-circulating pro-drugs by varying the molecular weight of the polymer, the molecular weight of the PEG segments, and the cleavable linkage between the drug and the polymer. The molecular weight of the PEG segments affects the spacing of the drug/linking group complex and the amount of drug per molecular weight of conjugate (smaller PEG segments provides greater drug loading). In general, increasing the overall molecular weight of the block co-polymer conjugate increases the circulatory half-life of the conjugate. Nevertheless, the conjugate must either be readily degradable or have a molecular weight below the threshold-limiting glomular filtration (e.g., less than 45 kDa). Thus, in one aspect, PEGylated LPLA2 proteins are in the range of between 20 and 35 kDa in molecular weight.

Another set of useful derivatives are the LPLA2 proteins conjugated to other therapeutic agents or diagnostic agents, including tracers, or radioisotopes. Useful conjugation partners include: radioisotopes, such as 90Yttrium, 131Iodine, 225Actinium, and 213Bismuth; ricin A toxin, microbially derived toxins such as Pseudomonas endotoxin (e.g., PE38, PE40), and the like; partner molecules in capture systems (see below); biotin, streptavidin (useful as either partner molecules in capture systems or as tracers, especially for diagnostic use); and chemotherapeutic agents.

Methods of Making LPLA2 Proteins

LPLA2 proteins can be produced by conventional automated peptide synthesis methods or by recombinant expression. General principles for designing and making proteins are well known to those of skill in the art.

A. Automated Solid-Phase Peptide Synthesis

In one aspect any protein of the invention is synthesized in solution or on a solid support in accordance with conventional techniques. Various automatic synthesizers are commercially available and is used in accordance with known protocols. See, for example, Stewart and Young, Solid Phase Peptide Synthesis, 2d. ed., Pierce Chemical Co., (1984); Tam et al., J. Am. Chem. Soc., 105:6442, (1983); Merrifield, Science, 232: 341-347, (1986); and Barany and Merrifield, The Peptides, Gross and Meienhofer, eds, Academic Press, New York, 1-284, (1979), each incorporated herein by reference. As such, LPLA2 proteins, fragments and variants thereof are readily synthesized and optionally screened for a related activity e.g., aclyceramide synthase activity assays.

For example, the peptides are synthesized by solid-phase technology employing an exemplary peptide synthesizer such as a Model 433A from Applied Biosystems Inc. In such cases, the purity of any given peptide substrate, generated through automated peptide synthesis or through recombinant methods, is typically determined using reverse phase HPLC analysis. Chemical authenticity of each peptide is established by any method well known to those of skill in the art. In certain embodiments, the authenticity is established by mass spectrometry. Additionally, the peptides also are quantified using amino acid analysis in which microwave hydrolyses are conducted, e.g. using a microwave oven such as the CEM Corporation's MDS 2000 microwave oven. In certain aspects, the samples are analyzed by reverse phase HPLC and quantification is achieved using an enhanced integrator. Those of skill in the art are referred to Hiraoka et a., which describes details of methods of determining amino acid sequence of LPLA2 using a combination of reverse phase HPLC and mass spectrometry. Such methods are well known to those of skill in the art and are readily adapted for the sequence analysis of any protein or peptide.

B. Recombinant Protein Production

As an alternative to automated peptide synthesis, recombinant DNA technology is employed wherein a nucleotide sequence which encodes a peptide of the invention is inserted into an expression vector, transformed or transfected into an appropriate host cell and cultivated under conditions suitable for expression as described herein below. In one aspect, a nucleotide sequence that encodes a protein of SEQ ID NOs: 1-288, a fragment or variant thereof is provided. Recombinant methods are especially useful for producing longer polypeptides for use in the methods of the invention.

A variety of expression vector/host systems are known in the art. These include but are not limited to microorganisms such as bacteria transformed with recombinant bacteriophage, plasmid or cosmid DNA expression vectors; yeast transformed with yeast expression vectors; insect cell systems infected with virus expression vectors (e.g., baculovirus); plant cell systems transfected with virus expression vectors (e.g., cauliflower mosaic virus, CaMV; tobacco mosaic virus, TMV) or transformed with bacterial expression vectors (e.g., Ti or pBR322 plasmid); or animal cell systems. Mammalian cells that are useful in recombinant protein productions include but are not limited to VERO cells, HeLa cells, Chinese hamster ovary (CHO) cell lines, COS cells (such as COS-7), W138, BHK, HepG2, 3T3, RIN, MDCK, A549, PC12, K562 and 293 cells. Exemplary protocols for the recombinant expression of the LPLA2 polypeptides in bacteria, yeast and other invertebrates are known to those of skill in the art and briefly described below.

Expression vectors for use in prokaryotic hosts generally comprise one or more phenotypic selectable marker genes. Such genes generally encode, e.g., a protein that confers antibiotic resistance or that supplies an auxotrophic requirement. A wide variety of such vectors are readily available from commercial sources. Examples include pSPORT vectors, pGEM vectors (Promega), pPROEX vectors (LTI, Bethesda, MD), Bluescript vectors (Stratagene), pET vectors (Novagen) and pQE vectors (Qiagen).

The DNA sequence encoding the given protein or fusion polypeptide is amplified by PCR and cloned into a vector, for example, pGEX-3X (Pharmacia, Piscataway, N.J.) designed to produce a fusion protein comprising glutathione-S-transferase (GST), encoded by the vector, and a protein encoded by a DNA fragment inserted into the vector's cloning site. Typically, the primers for the PCR are generated to include for example, an appropriate cleavage site. Plasmid DNA from individual transformants is purified and partially sequenced using an automated sequencer to confirm the presence of the desired encoding nucleic acid insert in the proper orientation. The vector is transformed into cells and the LPLA2 protein of interest is purified and recovered by cleavage of the recombinant fusion protein with thrombin or factor Xa (Pharmacia, Piscataway, N.J.).

The secreted recombinant protein is purified from the bacterial culture media by conventional protein purification methods. Similar systems for the production of recombinant protein in yeast host cells are readily commercially available, e.g., the Pichia Expression System (Invitrogen, San Diego, Calif.), following the manufacturer's instructions. Another alternative recombinant production is achieved using an insect system. Insect systems for protein expression are well known to those of skill in the art. In one such system, Autographa californica nuclear polyhedrosis virus (AcNPV) is used as a vector to express foreign genes in Spodoptera frugiperda cells or in Trichoplusia larvae. The substrate coding sequence is cloned into a nonessential region of the virus, such as the polyhedrin gene, and placed under control of the polyhedrin promoter. Successful insertion of substrate will render the polyhedrin gene inactive and produce recombinant virus lacking coat protein coat. The recombinant viruses are then used to infect S. frugiperda cells or Trichoplusia larvae in which the substrate is expressed (Smith et a., J Virol 46: 584, 1983; Engelhard EK et a., Proc Nat Acad Sci 91: 3224-7, 1994).

Mammalian host systems for the expression of recombinant proteins also are well known to those of skill in the art. Host cell strains are typically chosen for a particular ability to process the expressed protein or produce certain post-translation modifications that will be useful in providing protein activity. Such modifications of the polypeptide include, but are not limited to, acetylation, carboxylation, glycosylation, phosphorylation, lipidation and acylation. Post-translational processing which cleaves a "prepro" form of the protein may also be important for correct insertion, folding and/or function. Different host cells such as CHO, HeLa, MDCK, 293, WI38, and the like, have specific cellular machinery and characteristic mechanisms for such post-translational activities and are chosen to ensure the correct modification and processing of the introduced, foreign protein.

In one aspect, the transformed cells are used for long-term, high-yield protein production and as such stable expression is desirable. Once such cells are transformed with vectors that contain selectable markers along with the desired expression cassette, the cells are allowed to grow for 1-2 days in an enriched media before they are switched to selective media. The selectable marker is designed to confer resistance to selection and its presence allows growth and recovery of cells which successfully express the introduced sequences. Resistant clumps of stably transformed cells are proliferated using tissue culture techniques appropriate to the cell.

A number of selection systems are useful to recover the cells that have been transformed for recombinant protein production. Such selection systems include, but are not limited to, HSV thymidine kinase, hypoxanthine-guanine phosphoribosyltransferase and adenine phosphoribosyltransferase genes, in tk-, hgprt- or aprt- cells, respectively. In other aspects, anti-metabolite resistance is used as the basis of selection for dhfr, which confers resistance to methotrexate; gpt, which confers resistance to mycophenolic acid; neo, which confers resistance to the aminoglycoside G418; als which confers resistance to chlorsulfuron; and hygro, which confers resistance to hygromycin. Additional selectable genes that are useful include trpB, which allows cells to utilize indole in place of tryptophan, or hisD, which allows cells to utilize histinol in place of histidine. Markers that give a visual indication for identification of transformants include anthocyanins, β-glucuronidase and its substrate, GUS, and luciferase and its substrate, luciferin.

C. Expression Constructs for Recombinant Protein Production

Recombinant production of the LPLA2 proteins of the invention employs vectors comprising polynucleotide molecules that encode LPLA2 proteins. Methods of preparing such vectors as well as producing host cells transformed with such vectors are well known to those skilled in the art. In one aspect, the polynucleotide molecules used (e.g., a polynucleotide encoding a polypeptide of SEQ ID NOs: 1-288 or a fragment or variant thereof) are joined to a vector, which generally includes a selectable marker and an origin of replication, for propagation in a host. These elements of the expression constructs are well known to those of skill in the art. Generally, the expression vectors include DNA encoding the given protein being operably linked to suitable transcriptional or translational regulatory sequences, such as those derived from a mammalian, microbial, viral, or insect gene. Examples of regulatory sequences include transcriptional promoters, operators, or enhancers, mRNA ribosomal binding sites, and appropriate sequences which control transcription and translation.

The terms "expression vector," "expression construct" or "expression cassette" are used interchangeably throughout this specification and are meant to include any type of genetic construct containing a nucleic acid coding for a gene product in which part or all of the nucleic acid encoding sequence is capable of being transcribed, operably linked to a regulatory sequence.

The choice of a suitable expression vector for expression of the peptides or polypeptides of the invention will of course depend upon the specific host cell to be used, and is within the skill of the ordinary artisan. Methods for the construction of mammalian expression vectors are disclosed, for example, in Okayama and Berg (Mol. Cell. Biol. 3:280 (1983)); Cosman et al. (Mol. Immunol. 23:935 (1986)); Cosman et al. (Nature 312:768 (1984)); EP-A-0367566; and WO 91/18982.

In one aspect, expression construct comprises a selectable marker that allows for the detection of the expression of a peptide or polypeptide. Usually the inclusion of a drug selection marker aids in cloning and in the selection of transformants, for example, neomycin, puromycin, hygromycin, DHFR, zeocin and histidinol. Alternatively aspects employ enzymes such as herpes simplex virus thymidine kinase (tk) (eukaryotic), β-galactosidase, luciferase, or chloramphenicol acetyltransferase (CAT) (prokaryotic) as markers. Alternatively, immunologic markers also are employed. For example, epitope tags such as the FLAG system (IBI, New Haven, Conn.), HA and the 6xHis system (Qiagen, Chatsworth, Calif.) are employed. Additionally, glutathione S-transferase (GST) system (Pharmacia, Piscataway, N.J.), or the maltose binding protein system (NEB, Beverley, Mass.) also are used. The selectable marker employed is not believed to be important, so long as it is capable of being expressed simultaneously with the nucleic acid encoding a gene product. Further examples of selectable markers are well known to one of skill in the art.

Expression requires that appropriate signals be provided in the vectors, such as enhancers/promoters from both viral and mammalian sources that are used to drive expression of the nucleic acids of interest in host cells. Usually, the nucleic acid being expressed is under transcriptional control of a promoter. A "promoter" refers to a DNA sequence recognized by the synthetic machinery of the cell, or introduced synthetic machinery, required to initiate the specific transcription of a gene. Nucleotide sequences are operably linked when the regulatory sequence functionally relates to the DNA encoding the peptide substrate or the fusion polypeptide. Thus, a promoter nucleotide sequence is operably linked to a given DNA sequence if the promoter nucleotide sequence directs the transcription of the sequence. Similarly, the phrase "under transcriptional control" means that the promoter is in the correct location and orientation in relation to the nucleic acid to control RNA polymerase initiation and expression of the gene.

Any promoter that will drive the expression of the nucleic acid is used. The particular promoter employed to control the expression of a nucleic acid sequence of interest is not believed to be important, so long as it is capable of directing the expression of the nucleic acid in the targeted cell. Thus, where a human cell is targeted, it is preferable to position the nucleic acid coding region adjacent to and under the control of a promoter that is capable of being expressed in a human cell. In one aspect, such a promoter includes either a human or viral promoter. Common promoters include, e.g., the human cytomegalovirus (CMV) immediate early gene promoter, the SV40 early promoter, the Rous sarcoma virus long terminal repeat, β-actin, rat insulin promoter, the phosphoglycerol kinase promoter and glyceraldehyde-3-phosphate dehydrogenase promoter, all of which are promoters well known and readily available to those of skill in the art and are used to obtain high-level expression of the coding sequence of interest. The use of other viral or mammalian cellular or bacterial phage promoters which are well-known in the art to achieve expression of a coding sequence of interest is contemplated as well, provided that the levels of expression are sufficient for a given purpose. By employing a promoter with well known properties, the level and pattern of expression of the protein of interest following transfection or transformation is optimized. Inducible promoters also are contemplated for use.

Another regulatory element that is used in protein expression is an enhancer. These are genetic elements that increase transcription from a promoter located at a distant position on the same molecule of DNA. Where an expression construct employs a cDNA insert, one will typically desire to include a polyadenylation signal sequence to effect proper polyadenylation of the gene transcript. Any polyadenylation signal sequence recognized by cells of the selected transgenic animal species is suitable for the practice of the invention, such as human or bovine growth hormone and SV40 polyadenylation signals.

Also contemplated as an element of the expression cassette is a terminator. These elements serve to enhance message levels and to minimize read through from the cassette into other sequences. The termination region is selected for convenience, since termination regions for the applications such as those contemplated by the present invention appear to be relatively interchangeable. In certain aspects, the termination region is native with the transcriptional initiation, in other embodiments, it is native to the DNA sequence of interest, or alternatively it is derived for another source.

Gene Therapy

Expression vector can also be used for gene therapy to effect the expression of the protein in vivo. In one aspect, the expression constructs are introduced into the cells targeted for treatment using any methods known to those of skill in the art. For example, the expression constructs form part of a viral delivery vector. In other embodiments, non-viral delivery is contemplated. Receptor-mediated delivery also is contemplated (Ridgeway, In: Rodriguez R L, Denhardt D T, ed. Vectors: A survey of molecular cloning vectors and their uses. Stoneham: Butterworth, 467 492, 1988; Nicolas and Rubenstein, In: Vectors: A survey of molecular cloning vectors and their uses, Rodriguez & Denhardt (eds.), Stoneham: Butterworth, 493 513, 1988; Baichwal and Sugden, In: Gene Transfer, Kucherlapati R, ed., New York, Plenum Press, 117 148, 1986; Temin, In: gene Transfer, Kucherlapati (ed.), New York: Plenum Press, 149 188, 1986).

It is now widely recognized that DNA can be introduced into a cell using a variety of viral vectors. In various embodiments, expression constructs comprising viral vectors containing the genes of interest are adenoviral (see for example, U.S. Pat. Nos. 5,824,544; 5,707,618; 5,693,509; 5,670,488; 5,585,362; each incorporated herein by reference), retroviral (see for example, U.S. Pat. Nos. 5,888,502; 5,830,725; 5,770,414; 5,686,278; 4,861,719 each incorporated herein by reference), adeno-associated viral (see for example, U.S. Pat. Nos. 5,474,935; 5,139,941; 5,622,856; 5,658,776; 5,773,289; 5,789,390; 5,834,441; 5,863,541; 5,851,521; 5,252,479 each incorporated herein by reference), an adenoviral-adenoassociated viral hybrid (see for example, U.S. Pat. No. 5,856,152 incorporated herein by reference) or a vaccinia viral or a herpesviral (see for example, U.S. Pat. Nos. 5,879,934; 5,849,571; 5,830,727; 5,661,033; 5,328,688 each incorporated herein by reference) vector.

Non-viral gene transfer include calcium phosphate precipitation (Graham and Van Der Eb, Virology, 52:456-467, 1973; Chen and Okayama, Mol. Cell Biol., 7:2745-2752, 1987; Rippe et a., Mol. Cell Biol., 10:689-695, 1990) DEAE-dextran (Gopal, Mol. Cell Biol., 5:1188-1190, 1985), electroporation (Tur-Kaspa et a., Mol. Cell Biol., 6:716-718, 1986; Potter et a., Proc. Nat. Acad. Sci. USA, 81:7161-7165, 1984), direct microinjection (Harland and Weintraub, J. Cell Biol., 101:1094-1099, 1985.), DNA-loaded liposomes (Nicolau and Sene, Biochim. Biophys. Acta, 721:185-190, 1982; Fraley et a., Proc. Natl. Acad. Sci. USA, 76:3348-3352, 1979; Felgner, Sci Am. 276(6):102 6, 1997; Felgner, Hum Gene Ther. 7(15):1791 3, 1996), cell sonication (Fechheimer et a., Proc. Natl. Acad. Sci. USA, 84:8463-8467, 1987), gene bombardment using high velocity microprojectiles (Yang et a., Proc. Natl. Acad. Sci USA, 87:9568-9572, 1990), and receptor-mediated transfection (Wu and Wu, J. Biol. Chem., 262: 4429-4432, 1987; Wu and Wu, Biochemistry, 27:887-892, 1988; Wu and Wu, Adv. Drug Delivery Rev., 12:159-167, 1993).

Liposomal delivery is also contemplated (Radler et a., Science, 275(5301):810 4, 1997). Also contemplated in the present invention are various commercial approaches involving "lipofection" technology. Complexing the liposome with a hemagglutinating virus (HVJ) facilitates fusion with the cell membrane and promotes cell entry of liposome-encapsulated DNA (Kaneda et a., Science, 243:375-378, 1989). In other exemplary embodiments, the liposome is complexed or employed in conjunction with nuclear nonhistone chromosomal proteins (HMG-1) (Kato et al., J. Biol. Chem., 266: 3361-3364, 1991). In yet further embodiments, the liposome is complexed or employed in conjunction with both HVJ and HMG-1. In that such expression constructs have been successfully employed in transfer and expression of nucleic acid in vitro and in vivo, then they are applicable for the present invention.

Receptor-mediated gene targeting vehicles also are useful and generally consist of two components: a cell receptor-specific ligand and a DNA-binding agent. Several ligands have been used for receptor-mediated gene transfer. The most extensively characterized ligands are asialoorosomucoid (ASOR) (Wu and Wu, 1987, supra) and transferrin (Wagner et al., Proc. Nat'l. Acad Sci. USA, 87(9):3410-3414, 1990). Recently, a synthetic neoglycoprotein, which recognizes the same receptor as ASOR, has been used as a gene delivery vehicle (Ferkol et al., FASEB J., 7:1081-1091, 1993; Perales et al., Proc. Natl. Acad. Sci., USA 91:4086-4090, 1994) and epidermal growth factor (EGF) has also been used to deliver genes to squamous carcinoma cells (Myers, EPO 0273085).

In another embodiment of the invention, the expression construct simply consists of naked recombinant DNA or plasmids. Transfer of the construct is performed by any of the methods mentioned above which physically or chemically permeabilize the cell membrane. This is applicable particularly for transfer in vitro, however, it is also applied for in vivo use as well. Dubensky et al. (Proc. Nat. Acad. Sci. USA, 81:7529-7533, 1984; Benvenisty and Neshif (Proc. Nat. Acad. Sci. USA, 83:9551-9555, 1986). Naked DNA expression constructs also are transferred using particle bombardment (Klein et al., Nature, 327:70-73, 1987; Yang et al., Proc. Natl. Acad. Sci USA, 87:9568-9572, 1990).

Protein Purification

It is desirable to purify the LPLA2 proteins of the invention, for example, for use in the therapeutic methods of the present invention. Protein purification techniques are well known to those of skill in the art. These techniques involve, at one level, the crude fractionation of the cellular milieu to polypeptide and non-polypeptide fractions. Having separated the LPLA2 proteins/polypeptides of the invention from other proteins, the LPLA2 polypeptides of interest are further purified using chromatographic and electrophoretic techniques to achieve partial or complete purification (or purification to homogeneity). Analytical methods particularly suited to the preparation of a pure peptide are ion-exchange chromatography, exclusion chromatography; polyacrylamide gel electrophoresis; isoelectric focusing. A particularly efficient method of purifying peptides is fast protein liquid chromatography (FPLC) or even high performance liquid chromatography (HPLC). Exemplary HPLC conditions include those exemplified in Hiraoka et al., J Biol Chem 277, 10090-9, 2002.

Certain aspects of the present invention concern the purification, and in particular embodiments, the substantial purification, of an encoded polypeptide, protein or peptide. The term "purified polypeptide, protein or peptide" as used herein, is intended to refer to a composition, isolated from other components, wherein the polypeptide, protein or peptide is purified to any degree relative to its naturally-obtainable state. A purified polypeptide, protein or peptide therefore also refers to a polypeptide, protein or peptide, free from the environment in which it may naturally occur.

Generally, "purified" will refer to a polypeptide, protein or peptide composition that has been subjected to fractionation to remove various other components, and which composition substantially retains its expressed biological activity. Where the term "substantially purified" is used, this designation refers to a composition in which the polypeptide, protein or peptide forms the major component of the composition, such as constituting about 50%, about 60%, about 70%, about 80%, about 90%, about 95% or more of the proteins in the composition.

Various techniques suitable for use in protein purification well known to those of skill in the art. These include, for example, precipitation with ammonium sulphate, PEG, antibodies and the like or by heat denaturation, followed by centrifugation; chromatography steps such as ion exchange, gel filtration, reverse phase, hydroxylapatite and affinity chromatography; isoelectric focusing; gel electrophoresis; and combinations of such and other techniques. As is generally known in the art, it is believed that the order of conducting the various purification steps is interchangeable, or that certain steps are omitted, and still result in a suitable method for the preparation of a substantially purified polypeptide, protein or peptide.

Gene Therapy

Delivery of a therapeutic protein to appropriate cells can be effected via gene therapy ex vivo, in situ, or in vivo by use of any suitable approach known in the art, including by use of physical DNA transfer methods (e.g., liposomes or chemical treatments) or by use of viral vectors (e.g., adenovirus, adeno-associated virus, or a retrovirus). For example, for in vivo therapy, a nucleic acid encoding LPLA2, either alone or in conjunction with a vector, liposome, or precipitate may be injected directly into the subject, and in some embodiments, may be injected at the site where the expression of the LPLA2 compound is desired. For ex vivo treatment, the subject's cells are removed, the nucleic acid is introduced into these cells, and the modified cells are returned to the subject either directly or, for example, encapsulated within porous membranes which are implanted into the patient. See, e.g. U.S. Pat. Nos. 4,892,538 and 5,283,187. There are a variety of techniques available for introducing nucleic acids into viable cells. The techniques vary depending upon whether the nucleic acid is transferred into cultured cells in vitro, or in vivo in the cells of the intended host. Techniques suitable for the transfer of nucleic acid into mammalian cells in vitro include the use of liposomes, electroporation, microinjection, cell fusion, DEAE-dextran, and calcium phosphate precipitation. A commonly used vector for ex vivo delivery of a nucleic acid is a retrovirus.

Other in vivo nucleic acid transfer techniques include transfection with viral vectors (such as adenovirus, Herpes simplex I virus, or adeno-associated virus) and lipid-based systems. The nucleic acid and transfection agent are optionally associated with a microparticle. Exemplary transfection agents include calcium phosphate or calcium chloride co-precipitation, DEAE-dextran-mediated transfection, quaternary ammonium amphiphile DOTMA ((dioleoyloxypropyl) trimethylammonium bromide, commercialized as Lipofectin by GIBCO-BRL))(Felgner et al, (1987) Proc. Natl. Acad. Sci. USA 84, 7413-7417; Malone et al. (1989) Proc. Natl Acad. Sci. USA 86 6077-6081); lipophilic glutamate diesters with pendent trimethylammonium heads (Ito et al. (1990) Biochem. Biophys. Acta 1023, 124-132); the metabolizable parent lipids such as the cationic lipid dioctadecylamido glycylspermine (DOGS, Transfectam, Promega) and dipalmitoylphosphatidyl ethanolamylspermine (DPPES)(J. P. Behr (1986) Tetrahedron Lett. 27, 5861-5864; J. P. Behr et al. (1989) Proc. Natl. Acad. Sci. USA 86, 6982-6986); metabolizable quaternary ammonium salts (DOTB, N-(1-[2, 3-dioleoyloxy]propyl)-N,N,N-trimethylammonium methyl-sulfate (DOTAP)(Boehringer Mannheim), polyethyleneimine (PEI), dioleoyl esters, ChoTB, ChoSC, DOSC) (Leventis et al. (1990) Biochim. Inter. 22, 235-241); 3beta[N-(N', N'-dimethylaminoethane)carbamoyl]-cholesterol (DC-Chol), dioleoylphosphatidyl ethanolamine (DOPE)/3beta[N-(N',N'-dimethylaminoethane)-carbamoyl]cholesterolDC-Chol in one to one mixtures (Gao et al., (1991) Biochim. Biophys. Acta 1065, 8-14), speimine, spermidine, lipopolyamines (Behr et al., Bioconjugate Chem, 1994, 5: 382-389), lipophilic polylysines (LPLL) (Zhou et al., (1991) Biochim. Biophys. Acta 939, 8-18), [[(1,1,3,3-Tetramethyl-butyl)cre-soxy]ethoxy]ethyl]dimethylbe nzylammonium hydroxide (DEBDA hydroxide) with excess phosphatidylcholine/cholesterol (Ballas et al., (1988) Biochim. Biophys.

Acta 939, 8-18), cetyltrimethylammonium bromide (CTAB)/ DOPE mixtures (Pinnaduwage et al, (1989) Biochim. Biophys. Acta 985, 33-37), lipophilic diester of glutamic acid (TMAG) with DOPE, CTAB, DEBDA, didodecylammonium bromide (DDAB), and stearylamine in admixture with phosphatidylethanolamine (Rose et al., (1991) Biotechnique 10, 520-525), DDAB/DOPE (TransfectACE, GIBCO BRL), and oligogalactose bearing lipids. Exemplary transfection enhancer agents that increase the efficiency of transfer include, for example, DEAE-dextran, polybrene, lysosome-disruptive peptide (Ohmori N I et al, Biochem Biophys Res Commun Jun. 27, 1997;235(3):726-9), chondroitan-based proteoglycans, sulfated proteoglycans, polyethylenimine, polylysine (Pollard H et al. J Biol Chem, 1998 273 (13):7507-11), integrin-binding peptide CYGGRGDTP (SEQ ID NO: 291), linear dextran nonasaccharide, glycerol, cholesteryl groups tethered at the 3'-terminal internucleoside link of an oligonucleotide (Letsinger, R. L. 1989 Proc Natl Acad Sci USA 86: (17):6553-6), lysophosphatide, lysophosphatidylcholine, lysophosphatidylethanolamine, and 1-oleoyl lysophosphatidylcholine.

In some situations it may be desirable to deliver the nucleic acid with an agent that directs the nucleic acid-containing vector to target cells. Such "targeting" molecules include antibodies specific for a cell-surface membrane protein on the target cell, or a ligand for a receptor on the target cell. Where liposomes are employed, proteins which bind to a cell-surface membrane protein associated with endocytosis may be used for targeting and/or to facilitate uptake. Examples of such proteins include capsid proteins and fragments thereof tropic for a particular cell type, antibodies for proteins which undergo internalization in cycling, and proteins that target intracellular localization and enhance intracellular half-life. In other embodiments, receptor-mediated endocytosis can be used. Such methods are described, for example, in Wu et al., 1987 or Wagner et al., 1990. For review of the currently known gene marking and gene therapy protocols, see Anderson 1992. See also WO 93/25673 and the references cited therein. For additional reviews of gene therapy technology, see Friedmann, Science, 244: 1275-1281 (1989); Anderson, Nature, supplement to vol. 392, no 6679, pp. 25-30 (1998); Verma, Scientific American: 68-84 (1990); and Miller, Nature, 357: 455460 (1992).

Methods of Determining Enzymatic Activity of LPLA2

As indicated above, the LPLA2 proteins of used herein have transacylase activity. Such an enzyme activity is readily determined using assays known to those of skill in the art. As the LPLA2 proteins is generally specific for PE and PC, the substrates in any transacylase enzyme assay comprise, for example, one or both of these phospholipids. In one aspect, in an exemplary general assay, liposomes comprising dioleoylphosphatidylcholine (60.5 mol %), PE (27.3 mol %) and dicetyl phosphate (12.3 mol %) are used as the acyl group donor for the enzyme being tested. In exemplary assays, such liposomes are formed by mixing constituent lipids in chloroform and drying the mixture under a stream of nitrogen. Fifty mM sodium citrate (pH 4.5) is added to the dried lipids at a volume of 1 ml/128 nmol of lipid phosphorus. The lipids are caused to disperse into the buffer for 8 min in an ice-water bath using a probe sonicator. This procedure creates donor liposomes for the enzyme assay. Those skilled in the art understand that similar liposome commercially available.

Donor liposomes containing e.g., 64 nmol of phospholipid are incubated with 10 nmol of N-acetylsphingosine (NAS) or 5 nmol of [3H]NAS (10,000 cpm), 5 µg of bovine serum albumin, and LPLA2 protein containing preparation at 37° C. in a total volume of 500 µl of 40 mM sodium citrate (pH 4.5). The reaction is terminated by adding 3 ml of chloroform/methanol (2:1) plus 0.3 ml of 0.9% (w/v) NaCl. After centrifugation for 5 min at 800×g, the lower layer is transferred into another glass tube and dried down under a stream of nitrogen gas. The lipid extract is then analyzed using e.g., high performance applied thin layer chromatography (HPTLC) to confirm the presence of 1-O-acyl-N-acetylsphingosine (1-O-acyl-NAS). In exemplary embodiments, the HPTLC plate and developed in a solvent system consisting of chloroform/acetic acid (9:1). Of course the lipid catabolism also is readily analyzed using other techniques, such as gas chromatography, HPLC and the like.

In an exemplary embodiment, an HPTLC assay is performed using nonradioactive NAS, the TLC plate is dried, sprayed with 8% (w/v) $CuSO_4$ pentahydrate in water/methanol/concentrated $H_3PO_4$ (60:32:8), and charred for 15 min at 150° C. An image of the plate is taken by a scanner (UMAX Astra Scanner 2200) connected to a computer and scanned by the NIH Image program (Version 1.62) to estimate the density of each band. Known amounts of ceramide are used to obtain a standard curve. In an exemplary assay using radioactive NAS, 1-O-acyl-NAS is detected under a UV light with primulin spray, scraped, and counted. Other assays for enzyme activity are known to those of skill in the art and are readily adapted to determine whether a given LPLA2 variant or fragment possesses the requisite transacylase or phospholipase activity.

In addition to the above in vitro enzyme assays, those skilled in the art also test the enzymatic activity of any of the LPLA2 protein compositions described herein by determining the presence of tingible body macrophages in a sample prior to and after contacting the sample with the LPLA2 protein. Any of the above assays also are used to screen for potential therapeutics that decrease intracellular levels of tingible body macrophages.

Methods of Screening for Modulators of LPLA2

The present invention also contemplates methods for identifying additional agents that decrease intracellular levels of tingible body macrophages through augmenting, increasing or otherwise stimulating the activity of LPLA2, or increasing or otherwise stimulating the expression of LPLA2.

In the screening assays of the present invention, the candidate substance may first be screened for basic biochemical activity—e.g., in vitro stimulation of LPLA2 activity, and then tested for its ability to reduce accumulation of intracellular tingible body macrophages. To test this effect, animal models exhibiting an accumulation of tingible body macrophages are known, e.g., LPLA2−/− knockout mouse model.

Other mouse models for macrophage defects known in the art are also suitable to test a candidate substance for its ability to reduce accumulation of intracellular tingible body macrophages. These models include, but are not limited to: the Ro mouse model (Xue et al., Proc Natl Acad Sci U S A 100: 7503-7508, 2003), the Tyro 3 mouse model (Lu et al., Science 293: 306-311, 2001), the c-mer mouse model (Cohen et a., J Exp Med 196: 135-140, 2002), and the MFG-E8 mouse model (Hanayama et a., Science 304: 1147-1150, 2004).

a. Binding Assays

Preliminarily, candidate substances can be identified by screening for molecules that bind to LPLA2. Binding of a molecule to a target may, in and of itself, be stimulatory, due to steric, allosteric or charge-charge interactions. In some aspects, this is performed in solution, in other aspects it is performed on a solid phase and is utilized as a first round screen to rapidly eliminate certain compounds before moving into more sophisticated screening assays. In one embodiment of this kind, the screening of compounds that bind to the LPLA2 of SEQ ID NO: 1 or a fragment thereof is provided.

The LPLA2 can be free in solution, fixed to a support, or expressed in or on the surface of a cell. Either the LPLA2 or the compound to be screened is labeled, thereby permitting determining of binding. One may measure the amount of free label versus bound label to determine binding.

A technique for high throughput screening of compounds is described in WO 94/03564. Large numbers of small peptide test compounds are synthesized on a solid substrate, such as plastic pins or some other surface. The peptide test compounds are reacted with, for example, LPLA2 and washed. Bound polypeptide is detected by various methods.

LPLA2 can be fixed to a support by coating directly onto plates, or by using non-neutralizing antibodies to immobilize the polypeptide to a solid phase. Alternatively, LPLA2 fusion proteins containing a reactive region (such as, for example, a terminal region) can be used to link the LPLA2 active region to a solid phase.

b. In vitro Assays

Assays for determining the ability of a candidate substance to augment, increase or otherwise stimulate LPLA2 activity generally include the steps of: i) contacting a LPLA2 of SEQ ID NOs: 1-288 with a candidate modulator; ii) monitoring the activity of said LPLA2; and iii) comparing the activity of LPLA2 in the presence and absence of said candidate substance; wherein an increase in the activity of said LPLA2 indicates that the candidate substance will augment, increase or otherwise stimulate LPLA2 activity. Exemplary assays for determining LPLA2 activity are discussed above in the section entitled "Methods of Determining Enzymatic Activity of LPLA2."

Significant changes in activity and/or expression include those that are represented by alterations in activity of at least about 30%-40%, and in some aspects, by changes of at least about 50%, with higher values of course being possible.

Alternatively, the candidate substance is added to isolated peritoneal macrophages, e.g. macrophages from a animal model of lupus, and the number or phagocytic index of tingible body macrophages is determined in the presence and absence of the added candidate substance.

C. In vivo Assays

The present invention particularly contemplates the use of various animal models. As discussed above, there is a LPLA2-/- knockout mouse model. Other animal models of lupus are also known in the art, for example, the Ro mouse model, the Tyro 3 mouse model, the c-mer mouse model, and the MFG-E8 mouse model.

Treatment of these animals with test compounds will involve the administration of the compound, in an appropriate form, to the animal. Administration will be by any route that could be utilized for clinical or non-clinical purposes, including but not limited to oral, nasal, buccal, or even topical. Alternatively, administration is by intratracheal instillation, bronchial instillation, intradermal, subcutaneous, intramuscular, intraperitoneal or intravenous injection. Specifically contemplated are intravenous and other mechanisms for delivery of the candidate substance locally to lymphatic tissue.

Determining the effectiveness of a compound in vivo may involve a variety of different criteria. Such criteria include, but are not limited to, clearance of apoptotic bodies, reduction in accumulation of tingible body macrophages, survival, reduction of SLE-associated signs, symptoms or complications, and improvement of general physical state including activity. It also is possible to perform histologic studies on tissues from these mice, or to examine the molecular and morphological state of the cells, which includes cell size, other morphological indicators or alteration in the expression of genes involved in SLE disorders.

In the in vivo screening assays of the present invention, the compound is administered to a model animal, over period of time and in various dosages, and an alleviation of the accumulation of tingible body macrophages and associated lupus-like symptoms are monitored. Any improvement in one or more of these symptoms will be indicative of the candidate substance being a useful modulator.

d. Screening for Increased Expression of LPLA2

Candidate substances are screened for their ability to increase expression of LPLA2 using techniques known in the art. For example, cells that normally express LPLA2, or cells that do not normally express LPLA2 are contacted with a candidate substance for a period of time, and levels of LPLA2 mRNA are monitored, e.g. using quantitative PCR methods.

e. Candidate Substances

As used herein the term "candidate substance" refers to any molecule that may potentially act as a modulator of the LPLA2 of the present invention. In certain aspects, the candidate substance is a protein or fragment thereof, a small molecule inhibitor, or even a nucleic acid molecule. In other aspects, the candidate substance is a non-specific transcription factor, an upstream activator in a LPLA2 cascade, an inhibitor of a LPLA2 inhibitor, an inhibitor of a silencer (i.e., a DNA binding protein that inhibits transcription) or gene therapy that replaces a natural LPLA2 promoter with a more active promoter. Rational drug design includes not only comparisons with known modulators of phospholipases, but predictions relating to the structure of target molecules. Alternatively, rapid and efficient screening of entire libraries of unrelated or related organic chemical compounds, or combinatorially generated libraries (e.g., peptide libraries), is possible. Combinatorial approaches also lend themselves to rapid evolution of potential drugs by the creation of second, third and fourth generation compounds related to the first.

Compounds isolated from natural sources, such as animals, bacteria, fungi, plant sources, including leaves and bark, and marine samples are assayed as candidates for the presence of potentially useful pharmaceutical agents. It will be understood that the pharmaceutical agents to be screened could also be derived or synthesized from chemical compositions or man-made compounds. Thus, it is understood that the candidate substance identified by the present invention is a polypeptide, apolynucleotide, a small molecule inhibitor or any other compound that is designed through rational drug design starting from a known activator of a phospholipase A2 activity.

In some aspects of the invention, the candidate substance is a variant of LPLA2 prepared as described above. Such a variant is readily tested for increased LPLA2 activity using any of the assays described herein. In other aspects of the invention, the candidate substance is an anti-idiotypic antibodies of LPLA2. Anti-idiotypes are generated by producing antibodies specific for a given protein and then using such an antibody as an antigen to produce the anti-idiotypic antibody. As a mirror image of a mirror image, the binding site of anti-idiotype is an analog of the original antigen. Methods of making antibodies to antigens such as LPLA2 are known to those of ordinary skill in the art, and are disclosed, e.g., in Sambrook et al. (2000) and Harlow and Lane (1988). Anti-idiotypic antibodies can be generated by methods known in the art, including, e.g., Greenspan et al., FASEB. J., 7:437 (1993).

Diagnostic Methods

The invention also provides methods for diagnosing systemic lupus erythematosus, determining susceptibility to systemic lupus erythematosus, and monitoring progression of systemic lupus erythematosus. Such methods involve assaying body fluid, cells, or tissue samples from patients for the presence or absence of LPLA2 autoantibodies or for reduced or normal LPLA2 expression or activity, wherein the presence of LPLA2 autoantibodies suggests diagnosis of or susceptibility to disease, and wherein a reduced LPLA2 expression or activity suggests diagnosis of or susceptibility to disease.

Examples of body fluid samples include blood, serum, plasma, pleural fluid, pulmonary or bronchial lavage fluid, synovial fluid, peritoneal fluid, bone marrow aspirate, lymph, cerebrospinal fluid, ascites fluid, amniotic fluid, sputum, bladder washes, semen, urine, saliva, and tears. Examples of cells include white blood cells, B- or T- lymphocytes, peritoneal lymphocytes, macrophages or dendritic cells. Examples of tissues include biopsies from spleen, kidney, lung, lymph nodes or blood vessels. Suitable assay methods are well known in the art and illustrated in the examples herein.

In one aspect, such methods comprise determining lysosomal phospholipase A2 (LPLA2) enzymatic activity in a sample from an individual. The enzymatic activity levels of the patient can be compared to those of a normal individual, or alternatively can be compared to previous LPLA2 enzymatic activity levels from the same individual. Detection of LPLA2 enzymatic activity that is decreased in the individual compared to LPLA2 enzymatic activity in a normal individual (wherein said normal individual is known not to suffer from SLE), is suggestive of the diagnosis of SLE or systemic lupus erythematosus, and/or susceptibility to SLE or systemic lupus erythematosus. Detection of LPLA2 enzymatic activity that is decreased in the individual compared to a prior determination of LPLA2 enzymatic activity in the same individual is also suggestive of the diagnosis of SLE or systemic lupus erythematosus and/or susceptibility to SLE or systemic lupus erythematosus.

In another aspect, such methods comprise determining LPLA2 expression in cells or tissue from an individual. The LPLA2 expression levels of the patient can be compared to those of a normal individual, or alternatively can be compared to previous LPLA2 expression levels from the same individual. Detection of LPLA2 expression level that is decreased in the individual compared to LPLA2 expression level in a normal individual (wherein said normal individual is known not to suffer from SLE), is suggestive of the diagnosis of SLE or systemic lupus erythematosus and/or susceptibility to SLE or systemic lupus erythematosus. Detection of LPLA2 expression level that is decreased in the individual compared to a prior LPLA2 expression level in the same individual is also suggestive of the diagnosis of SLE or systemic lupus erythematosus and/or susceptibility to SLE or systemic lupus erythematosus.

In yet another aspect, such methods comprise detecting lysosomal phospholipase A2 (LPLA2) autoantibodies in a sample from an individual. Detecting increased LPLA2 autoantibodies in the individual compared to LPLA2 autoantibodies in a normal individual (wherein said normal individual is known not to suffer from SLE) is suggestive of the diagnosis of SLE or systemic lupus erythematosus and/or susceptibility to SLE or systemic lupus erythematosus. Detecting increased LPLA2 autoantibodies in a sample from an individual compared to prior levels of LPLA2 autoantibodies in the same individual is suggestive of the diagnosis of SLE or systemic lupus erythematosus and/or susceptibility to SLE or systemic lupus erythematosus.

In further aspects, the invention provides mehods of monitoring progression of SLE or systemic lupus erythematosus or rheumatoid arthritis in an individual. Such methods comprise periodic determination of levels of LPLA2 enzymatic activity, or levels of LPLA2 expression, or levels of LPLA2 autoantibodies, in samples taken from the individual over time. Levels can be measured every week, two weeks, three weeks, or monthly, or every 2, 3, 4, 5, 6, or 12 months. Decreasing levels of of LPLA2 enzymatic activity over time, or decreasing levels of LPLA2 expression over time, or increasing levels of LPLA2 autoantibodies over time are suggestive of progression of systemic lupus erythematosus.

In related aspects, the invention provides methods of monitoring effectiveness of drug therapy of SLE or systemic lupus erythematosus or rheumatoid arthritis. In some embodiments, the methods involve monitoring levels of exogenously administered LPLA2 enzyme, or fragment, variant or derivative thereof. In other embodiments, such methods comprise periodic determination of levels of LPLA2 enzymatic activity, or levels of LPLA2 expression, or levels of LPLA2 autoantibodies, in samples taken from the individual over time. Levels can be measured every week, two weeks, three weeks, or monthly, or every 2, 3, 4, 5, 6, or 12 months. Increasing levels of of LPLA2 enzymatic activity over time, or increasing levels of LPLA2 expression over time, or decreasing levels of LPLA2 autoantibodies over time are suggestive of therapeutic efficacy.

Alternatively, such methods involve determining the presence or absence of a polymorphism in the LPLA2 gene that results in reduced expression or activity, wherein the presence of such a polymorphism suggests diagnosis of or susceptibility to disease. Such methods may optionally involve amplifying the DNA or RNA from the sample. Such methods may be carried out by any means known in the art, including (a) hybridizing the DNA or RNA with an oligonucleotide probe and detecting hybridization; (b) electrophoretic analysis; (c) restriction fragment length polymorphism analysis; and (d) nucleotide sequence analysis. For hybridization, the probe is contacted with DNA from the sample under conditions that are sufficient to allow specific hybridization of the nucleic acid probe. "Specific hybridization", as used herein, indicates exact hybridization (e.g., with no mismatches). Specific hybridization can be performed under high stringency conditions or moderate stringency conditions, preferably high stringency. See Current Protocols in Molecular Biology, Ausubel, F. et al., eds., John Wiley & Sons. Alternatively, the probe is contacted with RNA from the sample under specific hybridization conditions, to identify the presence of a polymorphism or a particular splicing variant. Mutation analysis by restriction digestion can be used to detect a polymorphism(s), if the mutation or polymorphism in the nucleic acid results in the creation or elimination of a restriction site. DNA, possibly including flanking sequences, is amplified and digested with a restriction enzyme that cleaves at the restriction site that has been created or eliminated by the polymorphism. RFLP analysis is conducted as known in the art (see Current Protocols in Molecular Biology, supra). The digestion pattern of the relevant DNA fragment indicates the presence or absence of the polymorphism. Sequencing of the relevant DNA or RNA, and comparison with normal gene sequence, can also be used to detect polymorphisms Dot-blot hybridization of amplified DNA or RNA with allele-specific oligonucleotide (ASO) probes (see, for example, Saiki, R. et al., Nature 324:163-166 (1986)) is also known in the art. An "allele-specific oligonucleotide" (also referred to herein as an "allele-specific oligonucleotide probe") is an oligonucleotide of approximately 10-50 base pairs, for example, approximately 15-30 base pairs, that specifically hybridizes to a gene containing a polymorphism associated with disease.

Methods of Treating Autoimmune Disorders

As described herein throughout, it has been discovered that LPLA2 proteins are used to improve the clearance of apoptotic bodies and/or reduce accumulation of intracellular tingible body macrophages. As such, the invention provides any LPLA2 of SEQ ID NO: 1-288, or a fragment, variant or derivative that retains the desired biological activity for use in the treatment of any disorder displaying the symptom of accumulation of tingible body macrophages. In a related aspect, the invention provides methods of treatment using agents that decrease intracellular levels of tingible body macrophages through augmenting, increasing or otherwise stimulating the activity of LPLA2, or increasing or otherwise stimulating the expression of LPLA2.

In certain aspects, the methods of the invention are useful in the treatment of SLE, including systemic lupus erythematosus, drug-induced lupus, neonatal lupus, and cutaneous lupus. However, it should be understood that in one aspect, the methods of the invention are useful in the treatment of any and all disorders that manifest in the accumulation of intracellular tingible body macrophages, including other autoimmune disorders such as rheumatoid arthritis. The invention also specifically contemplates use of any of the therapeutic agents described herein in the preparation of a medicament for the treatment of the above-described disorders.

To achieve the appropriate therapeutic outcome, either by administration of the LPLA2-related compositions alone or in combination with other therapeutic modalities, one generally administers to the subject the therapeutic protein composition in an effective amount. "Effective amount" is an amount effective to produce the desired therapeutic outcome reproducibly, i.e., an alleviation of one or more of the signs or symptoms or complications of the disease.

Administration of these compositions according to the present invention will be via any route so long as the target tissue is available via that route. However, other conventional routes of administration, e.g., parenterally, subcutaneous, intravenous, intradermal, intramuscular, intramammary, intraperitoneal, intrathecal, intraocular, retrobulbar, intrapulmonary, intratracheal instillation, bronchial instillation, aerosol, sublingual, oral, nasal, anal, vaginal, or transdermal delivery, or by surgical implantation at a particular site. Specifically contemplated are intravenous and other mechanisms for delivery of the candidate substance locally to lymphatic tissue.

The treatment may consist of a single dose or a plurality of doses over a period of time. Administration of the compositions can be systemic or local, and may comprise a single site injection or infusion of a therapeutically-effective amount of the LPLA2 protein composition. Alternatively, it is contemplated that the therapeutic composition may be delivered to the patient at multiple sites. The multiple administrations may be rendered simultaneously or may be administered over a period of time. Additional therapy may be administered on a period basis, for example, daily, weekly, or monthly.

In certain embodiment, parenteral administration of the therapeutic compounds is carried out with an initial bolus followed by continuous infusion to maintain therapeutic circulating levels of drug product. Those of ordinary skill in the art will readily optimize effective dosages and administration regimens as determined by good medical practice and the clinical condition of the individual patient.

The frequency of dosing will depend on the pharmacokinetic parameters of the agents and the routes of administration. Depending on the route of administration, a suitable dose is calculated according to body weight, body surface areas or organ size. The availability of animal models is particularly useful in facilitating a determination of appropriate dosages of a given therapeutic. In one aspect, the dosage is determined using an animal model, such as the LPLA2−/− knockout mouse model described herein, and modified and adapted to use in higher mammals.

Further refinement of the calculations necessary to determine the appropriate treatment dose is routinely made by those of ordinary skill in the art without undue experimentation. The final dosage regimen will be determined by the attending physician, considering factors which modify the action of drugs, e.g., the drug's specific activity, severity of the damage and the responsiveness of the patient, the age, condition, body weight, sex and diet of the patient, the severity of any infection, time of administration, kind of concurrent treatment, if any, frequency of treatment, and the nature of the effect desired, and other clinical factors. As studies are conducted, further information will emerge regarding appropriate dosage levels and duration of treatment for specific diseases and conditions.

In certain embodiments, the compositions are administered alone, in other embodiments the compositions are administered in conjunction with other therapeutics directed to the disease or directed to other symptoms thereof. Dosage levels of the order from about 0.01 mg to 30 mg per kilogram of body weight per day, for example from about 0.1 mg to 10 mg/kg.

It will be appreciated that the pharmaceutical compositions and treatment methods of the invention are useful in fields of human medicine and veterinary medicine. Thus the subject to be treated is a mammal, such as a human or other mammalian animal. For veterinary purposes, subjects include for example, farm animals including cows, sheep, pigs, horses and goats, companion animals such as dogs and cats, exotic and/or zoo animals, laboratory animals including mice rats, rabbits, guinea pigs and hamsters; and poultry such as chickens, turkey ducks and geese. The patient being treated is of any age, for example, between the ages of 10-50 years, age 20 or less, or age 10 or less.

In addition, it is contemplated that the peptide/protein-based compositions of the present invention are used in combination with any present treatments for disorders associated with an abnormal accumulation of tingible body macrophages. For example, in certain embodiments, it is contemplated that the methods of the invention are useful in combination with known SLE therapy. Compositions comprising LPLA2, or a fragment, variant or derivative thereof, are administered before, after or during such therapy.

Combination therapy with other agents or drugs for treating SLE include, but are not limited to, anti-inflammatory drugs (NSAIDs) such as aspirin, ibuprofen (Motrin), naproxen (Naprosyn) and sulindac (Clinoril), cyclooxygenase-2 (COX-2) inhibitors including Celecoxib (Celebrex), rofecoxib (Vioxx), valdecoxib (Bextra) and Meloxicam (Mobicox), corticosteroids such as prednisone, hydrocortisone, methylprednisolone, and dexamethasone, hydroxychlooquine (Plaquenil), mycophenolate mofetil (Cellcept), chloroquine (Aralen), quinacrine, rituximab (Rituxan), dapsone, retinoic acid (Retin-A), plasmapheresis, cytotoxic drugs such as methotrexate (Rheumatrex, Trexall), azathioprine (Imuran), cyclophosphamide (Cytoxan), chlorambucil (Leukeran), and cyclosporine (Sandimmune) and the costimulation blocker CTLA41G. The combined therapies contemplated herein, i.e., combinations of LPLA2-based compositions with SLE drugs are, in one aspect, administered in a combined amount effective to produce a decrease in the accumulation of tingible body macrophages. Such a combined administration in some aspects alleviates one or more signs, symptoms or complications that are associated with an accumulation of intracellular tingible body macrophages.

Pharmaceutical Compositions

Pharmaceutical compositions for administration according to the present invention can comprise at least one LPLA2-derived protein (e.g., a protein of SEQ ID NOs: 1-288, a variant or derivative thereof or any other LPLA2-derived protein that stimulates the catabolism of tingible body macrophages). The pharmaceutical compositions also include another agent that is used for the treatment of SLE, e.g., NSAIDs, corticosteroids or cytotoxic agents. Each of these preparations is in some aspects provided in a pharmaceutically acceptable form optionally combined with a pharmaceutically acceptable carrier. These compositions are preferably sterile and may be administered by any methods that achieve their intended purposes.

The instant compositions can be formulated for various routes of administration, for example, by oral administration, by transmucosal administration (including pulmonary and nasal administration), parenteral administration (including subcutaneous administration), transdermal (topical) administration or by rectal administration, as well as intrathecal, intravenous, intramuscular, intraperitoneal, intranasal, intraocular or intraventricular injection. The compound or compounds of the instant invention can also be administered in a local rather than a systemic fashion, such as injection as a sustained release formulation.

The optimal pharmaceutical formulation will be determined by one of skill in the art depending on the route of administration and the desired dosage. Such formulations may influence the physical state, stability, rate of in vivo release and rate of in vivo clearance of the administered agents.

Besides those representative dosage forms described herein, pharmaceutically acceptable excipients and carriers are generally known to those skilled in the art and are thus included in the instant invention. Such excipients and carriers are described, for example, in "Remingtons Pharmaceutical Sciences" Mack Pub. Co., New Jersey Injectable dosage forms for parenteral administration generally include aqueous suspensions or oil suspensions, which may be prepared using a suitable dispersant or wetting agent and a suspending agent. Generally, this will entail preparing compositions that are essentially free of pyrogens, as well as other impurities that could be harmful to humans or animals. Injectable forms may be in solution phase or provided as a lyophilized powder suitable for reconstitution as a solution. Both are prepared with a solvent or diluent. Acceptable solvents or vehicles include sterilized water, Ringer's solution, or an isotonic aqueous saline solution. Alternatively, sterile oils may be employed as solvents or suspending agents. Typically, the oil or fatty acid is non-volatile, including natural or synthetic oils, fatty acids, mono-, di- or tri-glycerides. For injection, the formulations may optionally contain stabilizers, pH modifiers, surfactants, bioavailability modifiers and combinations of these. The compounds may be formulated for parenteral administration by injection such as by bolus injection or continuous infusion. A unit dosage form for injection may be in ampoules or in multi-dose containers.

The formulations of the invention may be designed to be short-acting, fast-releasing, long-acting, and sustained-releasing as described below. Thus, the pharmaceutical formulations may also be formulated for controlled release or for slow release. The instant compositions may also comprise, for example, micelles or liposomes, or some other encapsulated form, or may be administered in an extended release form to provide a prolonged storage and/or delivery effect. Therefore, the pharmaceutical formulations may be compressed into pellets or cylinders and implanted intramuscularly or subcutaneously as depot injections or as implants such as stents. Such implants may employ known inert materials such as silicones and biodegradable polymers.

Any of the above dosage forms containing effective amounts are well within the bounds of routine experimentation and therefore, well within the scope of the instant invention.

Compositions within the scope of this invention include all compositions comprising at least one LPLA2-derived protein according to the present invention in an effective amount. In some aspects, such treatment will result in an alleviation of one or more signs or symptoms or complications of SLE discussed above.

One will generally desire to employ appropriate salts and buffers to render the compositions stable and allow for uptake of the compositions at the target site. Generally the protein compositions of the invention are provided in lyophilized form to be reconstituted prior to administration. Buffers and solutions for the reconstitution of the therapeutic agents may be provided along with the pharmaceutical formulation to produce aqueous compositions of the present invention for administration. Such aqueous compositions will comprise an effective amount of each of the therapeutic agents being used, dissolved or dispersed in a pharmaceutically acceptable carrier or aqueous medium. The phrase "pharmaceutically or pharmacologically acceptable" refer to molecular entities and compositions that do not produce adverse, allergic, or other untoward reactions when administered to an animal or a human. As used herein, "pharmaceutically acceptable carrier" includes any and all solvents, dispersion media, coatings, antibacterial and antifungal agents, isotonic and absorption delaying agents and the like. The use of such media and agents for pharmaceutically active substances is well known in the art. Except insofar as any conventional media or agent is incompatible with the therapeutic compositions, its use in therapeutic compositions is contemplated. Supplementary active ingredients also are incorporated into the compositions.

Methods of formulating proteins and peptides for therapeutic administration also are known to those of skill in the art. In certain embodiments, the active compounds are prepared for administration as solutions of free base or pharmacologically acceptable salts in water suitably mixed with a surfactant, such as hydroxypropylcellulose. Dispersions also are prepared in glycerol, liquid polyethylene glycols, and mixtures thereof and in oils. Under ordinary conditions of storage and use, these preparations contain a preservative to prevent the growth of microorganisms.

The pharmaceutical forms suitable for injection include sterile aqueous solutions or dispersions and sterile powders for the extemporaneous preparation of sterile injectable solutions or dispersions. In all cases the form must be sterile and must be fluid to the extent that easy syringability exists. It must be stable under the conditions of manufacture and storage and must be preserved against the contaminating action of microorganisms, such as bacteria and fungi. In some aspects, the carrier is a solvent or dispersion medium containing, for example, water, ethanol, polyol (for example, glycerol, propylene glycol, and liquid polyethylene glycol, and the like), suitable mixtures thereof, and vegetable oils. The proper fluidity is maintained, for example, by the use of a coating, such as lecithin, by the maintenance of the required particle size in the case of dispersion and by the use of surfactants. The prevention of the action of microorganisms is brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions is brought about by the use in the compositions of agents delaying absorption, for example, aluminum monostearate and gelatin.

Sterile injectable solutions are prepared by incorporating the active compounds in the required amount in the appropriate solvent with various of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the methods of preparation are vacuum-drying and freeze-drying techniques which yield a powder of the active ingredient plus any additional desired ingredient from a previously sterile-filtered solution thereof.

In some aspects, the compositions of the present invention are formulated in a neutral or salt form. Pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups also are derived from inorganic bases such as, for example, sodium, potassium, ammonium, calcium, or ferric hydroxides, and such organic bases as isopropylamine, trimethylamine, histidine, procaine and the like.

Upon formulation, solutions will be administered in a manner compatible with the dosage formulation and in such amount as is therapeutically effective. The formulations are easily administered in a variety of dosage forms such as injectable solutions, drug release capsules and the like. For parenteral administration in an aqueous solution, for example, the solution is suitably buffered if necessary and the liquid diluent first rendered isotonic with sufficient saline or glucose. These particular aqueous solutions are especially suitable for intravenous, intramuscular, subcutaneous and intraperitoneal administration.

"Unit dose" is defined as a discrete amount of a therapeutic composition dispersed in a suitable carrier.

The present invention also contemplates kits for use in the treatment of the intracellular accumulation of tingible body macrophages, e.g. SLE or systemic lupus erythematosus. Such kits include at least a first sterile composition comprising the proteins/peptides described above in a pharmaceutically acceptable carrier. Another component is optionally a second therapeutic agent for the treatment of the disorder along with suitable container and vehicles for administrations of the therapeutic compositions. The kits may additionally comprise solutions or buffers for suspending, diluting or effecting the delivery of the first and second compositions. The kits may further comprise catheters, syringes or other delivering devices for the delivery of one or more of the compositions used in the methods of the invention. The kits may further comprise instructions containing administration protocols for the therapeutic regimens.

The following examples are provided in order to demonstrate and further illustrate certain preferred embodiments and aspects of the present invention and are not to be construed as limiting the scope thereof.

EXAMPLE 1

Characterization of LPLA2−/− Knockout Mice

Double conditional gene targeting was employed to elucidate the function of LPLA2. LPLA2-deficient mice (LPLA2−/−) were generated by the systemic deletion of exon 5 of the LPLA2 gene, which encodes the lipase motif essential for the phospholipase A2 activity (Hiraoka, M., Abe, A., Lu, Y., Yang, K., Han, X., Gross, R. W., and Shayman, J. A. Mol Cell Biol 26, 6139-6148 2006). The survival of the LPLA2−/− mice was normal. LPLA2−/− mouse mating pairs yielded normal litter sizes, indicating that the gene deficiency did not impair fertility or fecundity. Alveolar macrophages from wild-type but not LPLA2−/− mice readily degraded radiolabeled phosphatidylcholine. By three months of age, a marked accumulation of phospholipids, in particular phosphatidylethanolamine and phosphatidylcholine, was found in the alveolar macrophages, the peritoneal macrophages and the spleens of LPLA2−/− mice. The ultrastructural examination of LPLA2−/− mouse alveolar and peritoneal macrophages revealed the appearance of foam cells with lamellar inclusion bodies, a hallmark of cellular phospholipidosis. This finding was not surprising since very high expression of LPLA2 mRNA and protein had been observed in alveolar macrophages, consistent with a role for LPLA2 in surfactant catabolism (Abe, A., Hiraoka, M., Wild, S., Wilcoxen, S. E., Paine, R., 3rd, and Shayman, J. A. J Biol Chem 279, 42605-42611 2004).

Figure 2:
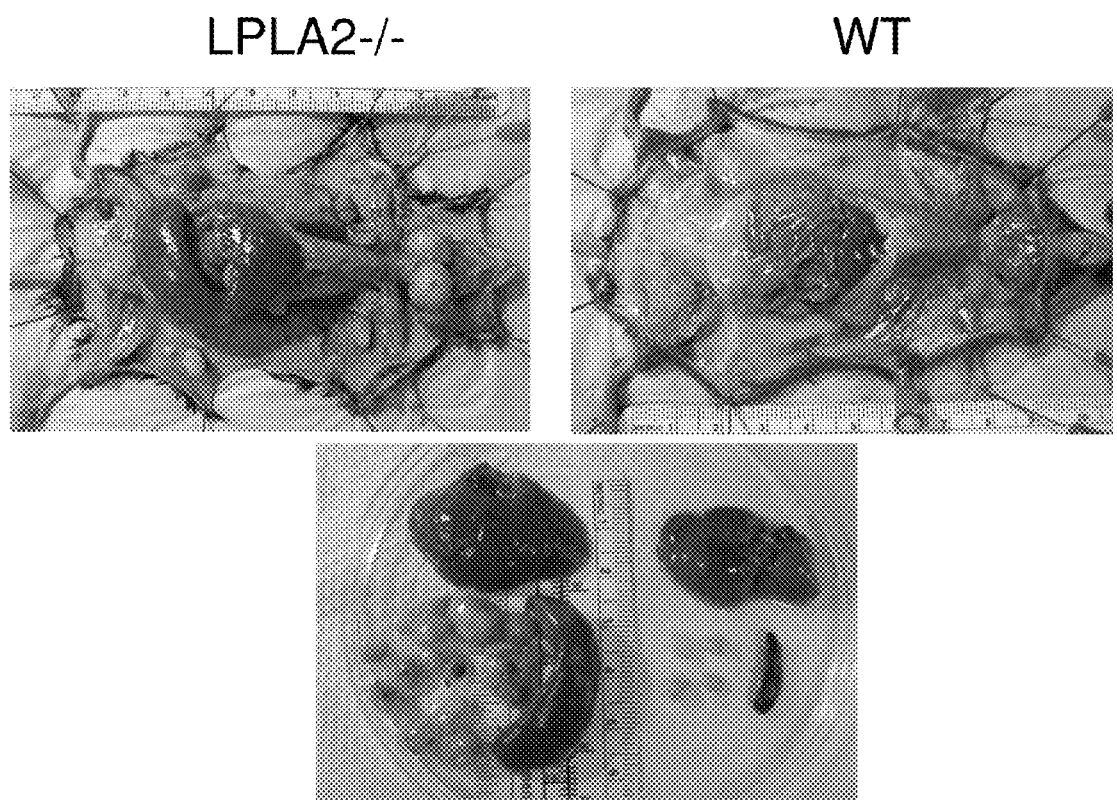
FIG. 2. Gross anatomical changes in 20 month old LPLA2−/− knockout and LPLA2+/+ wild type mice.
Figure 3:
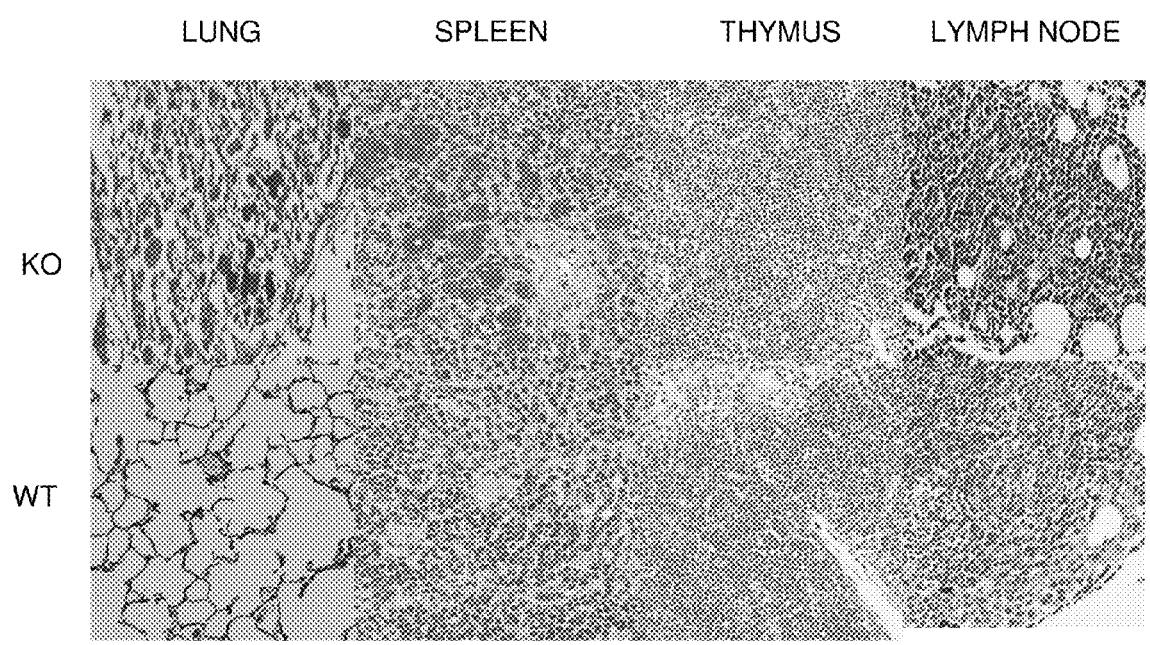
FIG. 3. Histological changes in 20 month old LPLA2−/− knockout and LPLA2+/+ wild type mice. Tissues sections were stained with periodic acid Schiff reagent. Pink staining cells represent lipid laden macrophages.

By six months of age the LPLA2 null mice began to develop signs of lymphoproliferation. Splenic enlargement was readily apparent as was adenopathy. By 18 months of age the spleens were greater than 10 times the weight of those obtained from the wild type mice and diffuse lymphadenopathy was readily apparent. Female mice demonstrated a significantly greater predilection toward increased organ weight than male mice. By 20 months of age the knockout mice displayed weight loss with signs of wasting as evidenced by loss of subcutaneous fat (FIG. 2). Histological analysis of the lymphoid organs revealed the presence of macrophages with a foam cell phenotype and the loss of stromal architecture (FIG. 3). Flow cytometric analysis of the splenic lymphocytes revealed a polyclonal expansion of both B and T cells.

Figure 4A:
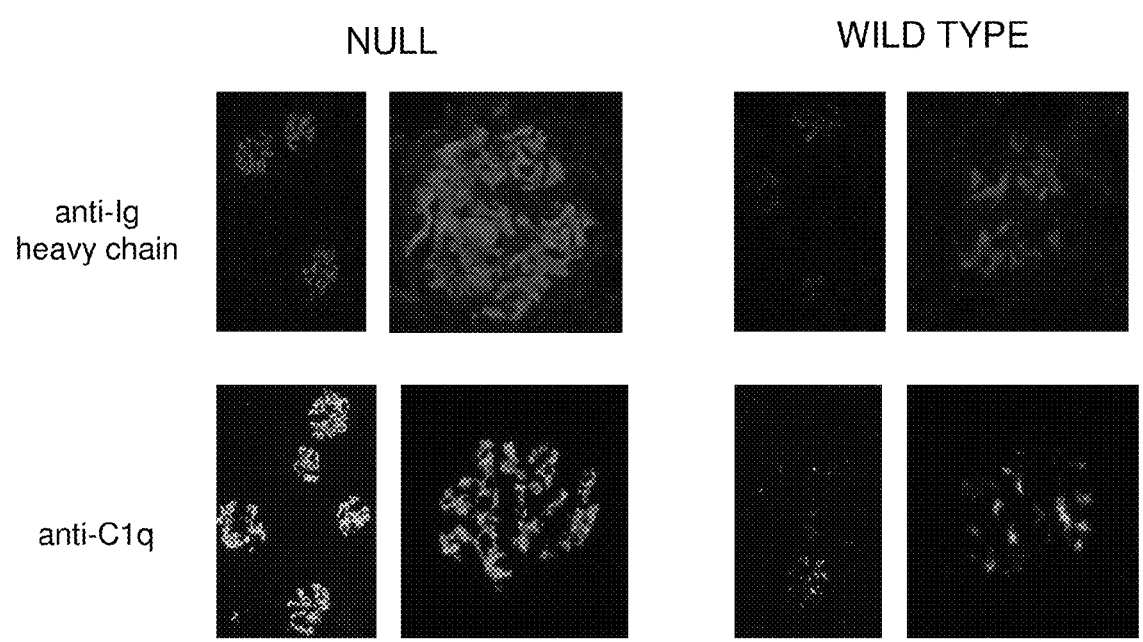
FIG. 4A. Immunofluorescent staining of LPLA2−/− knockout and LPLA2+/+ wild type mouse kidneys for Ig heavy chain and C1q.
Figure 4B:
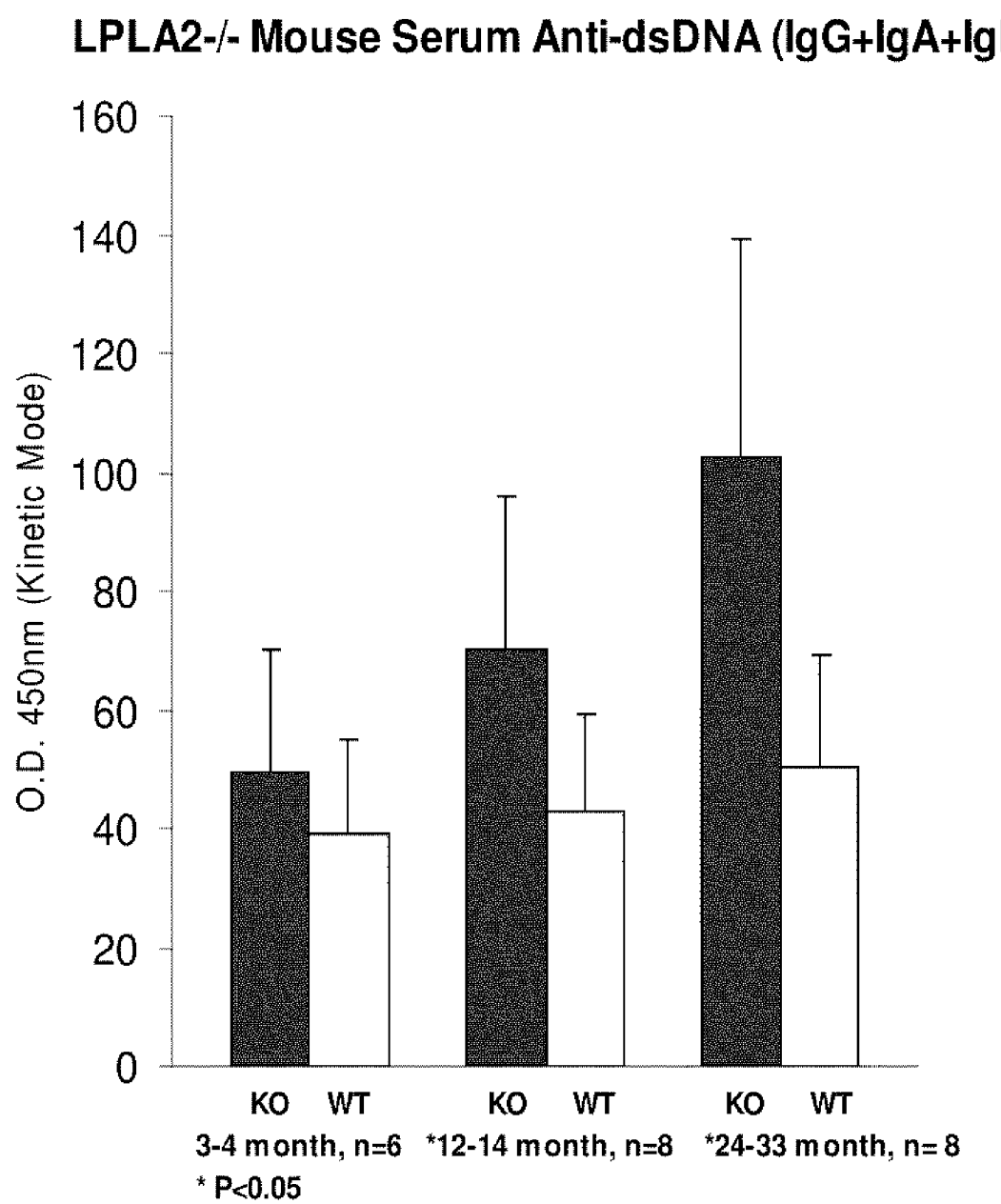
FIG. 4B. Anti-dsDNA titers for 3-4 month old, 12-14 month old and 24 month old LPLA2+/+ wild type and LPLA2 null mice.
Figure 4C:
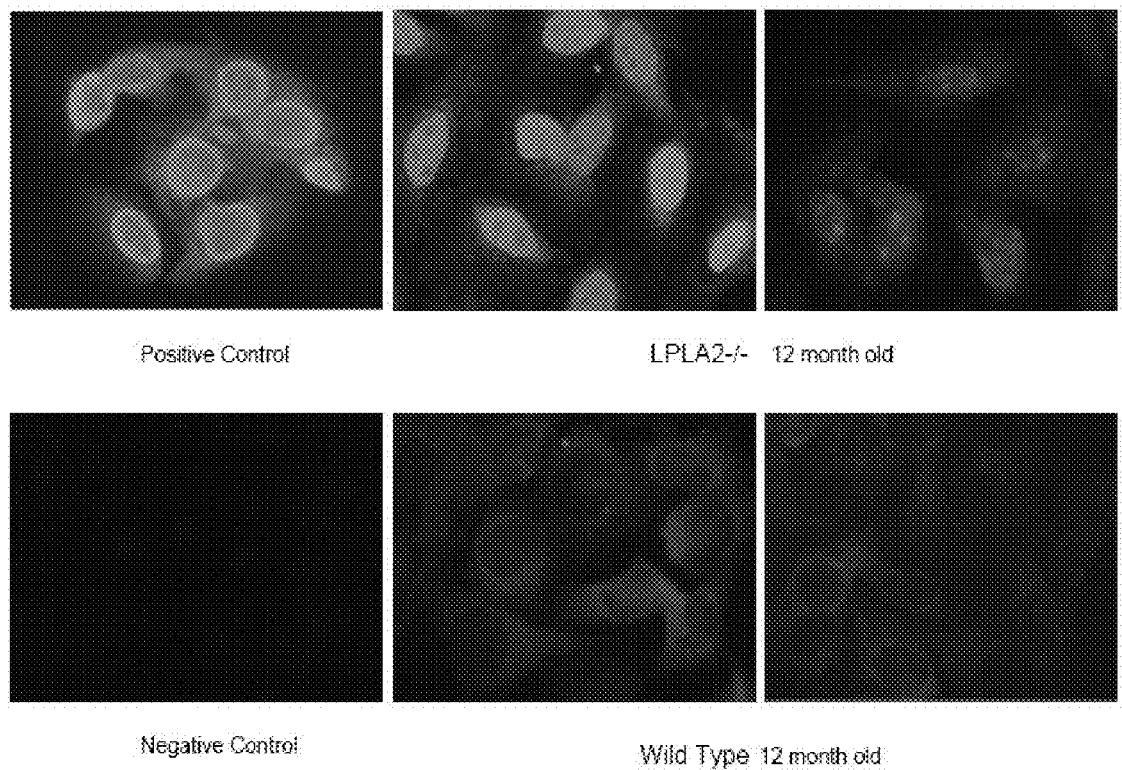
FIG. 4C. ANA staining of HeLa cells from 12 month old LPLA2+/+ wild type and LPLA2−/− knockout mice. Both homogenous and speckled nuclear stainings are observed in assays using the knockout mouse sera.
Figure 4D:
FIG. 4D. Identification of tingible bodies associated with macrophages in spleens from LPLA2−/− knockout mice. Frozen sections were stained for CD68 (red) and apoptotic bodes with a TUNEL stain (green).
Figure 4D:
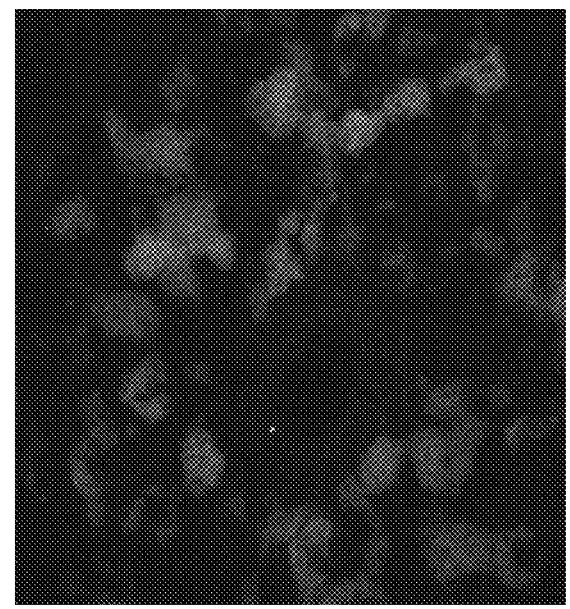

Histological analysis of the kidneys of LPLA2−/− mice revealed the presence of an immune complex glomerulonephritis with a "full house" pattern of deposition. LPLA2−/− mice showed proliferative changes and loss of capillary loop patency, consistent with a proliferative glomerulonephritis. Corresponding transmission electron micrographs demonstrated foot process effacement, immune complex deposition, and the presence of electron dense apoptotic bodies. Immunofluorescence demonstrated increased Ig and C1q deposition in the glomeruli of the null (LPLA2−/−) verse wild type (LPLA2+/+) mice (FIG. 4A). By transmission electron microscopy, immune complex deposition was evident in various glomerular compartments including mesangial, subepithelial, and subendothelial regions. Serum immunoglobulin levels were markedly elevated in the older mice and anti-dsDNA titers were significantly elevated in an age dependent fashion (FIG. 4B) as was the presence of ANAs (FIG. 4C). The spleens were characterized by numerous enlarged macrophages and the presence of massive amounts of tingible bodies consistent with the inability to clear apoptotic cells (FIG. 4D). Frozen sections of KO LPLA2−/− mice spleens were stained for CD68 (red) and apoptotic bodes with a TUNEL stain (green) (FIG. 4D).

Figure 5:
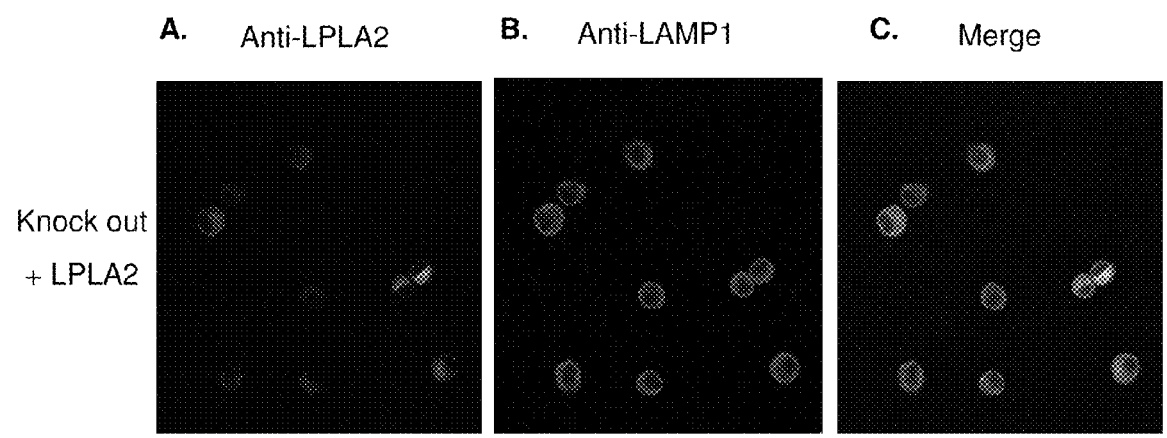
FIG. 5A-5C. Immunofluorescence staining of macrophages from LPLA2 null mice, treated with recombinant LPLA2. LPLA2 was added to the null cells for 2 hours. The macrophages were then fixed and stained with either anti-LPLA2 monoclonal antibody (green) (FIG. 5A) or an antibody against the lysosomal marker LAMP-1 (red) (FIG. 5B). Alex-flour coupled secondary antibodies were used to assess uptake and co-localization (FIG. 5C).

A primary mode of action of LPLA2 is the degradation of extracellular phospholipids to form free fatty acids and lyso-phosphatidylcholine and lyso-phospharidylethanomine. LPLA2 is secreted from macrophages following activation by ligand, subsequently binds to mannose receptors on the macrophage and is trafficed back to the lysosome. To assess uptake and co-localization of LPLA2 and lysosomes, macrophages from LPLA2−/− KO mice were treated with recombinant LPLA2, fixed and stained with an anti-LPLA2 monoclonal antibody (green) (FIG. 5A) or an antibody against the lysosomal marker LAMP-1 (red) (FIG. 5B). FIG. 5C shows an overlay of FIGS. 5A and 5B where yellow indicates co-localization of LPLA2 and the lysosome.

Figure 6:
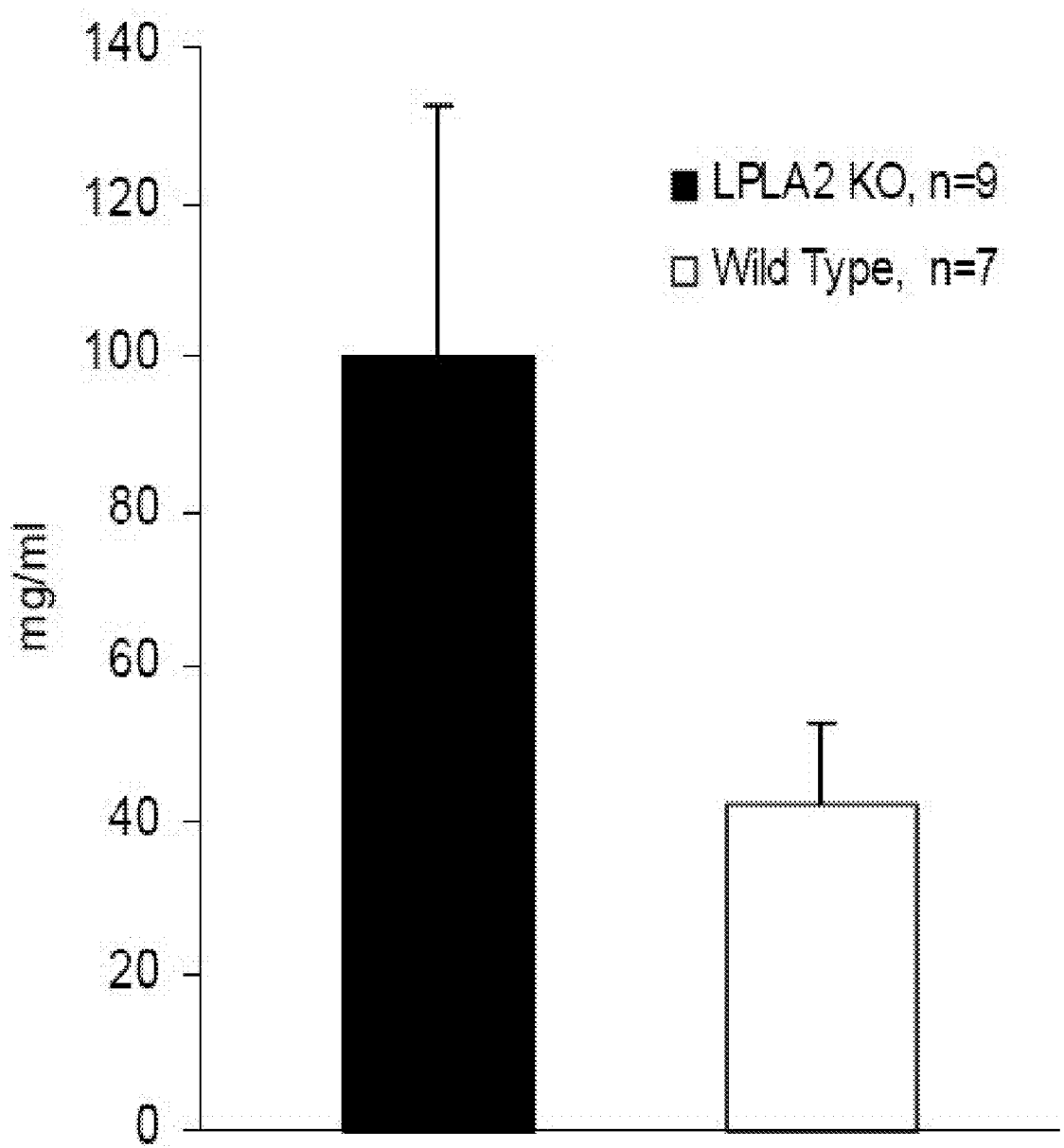
FIG. 6. 24 hour protein excretion in knockout (KO) LPLA2−/− mice versus wild type (WT) LPLA2+/+ mice.

Additional changes in the 18 month and older mice included the development of renal insufficiency and proteinuria. FIG. 6 shows that 24 hour protein excretion is more than 2-fold elevated in the LPLA2−/− mice compared to wild type mice. Creatinine concentrations were also elevated in LPLA2−/− mice (0.63+/31 0.22) versus the LPLA2+/+ mice (0.25+/31 0.06).

EXAMPLE 2

Impaired Digestion of Apoptotic Bodies can be Recapitulated in Peritoneal Macrophages from LPLA2−/− Mice In order to determine whether the appearance of apoptotic bodies within the spleens and glomeruli of LPLA2−/− knockout mice resulted from a generalized defect in the digestion of endocytosed apoptotic cells,, a LPLA2 defect was recapitulated in vitro.

Figure 7:
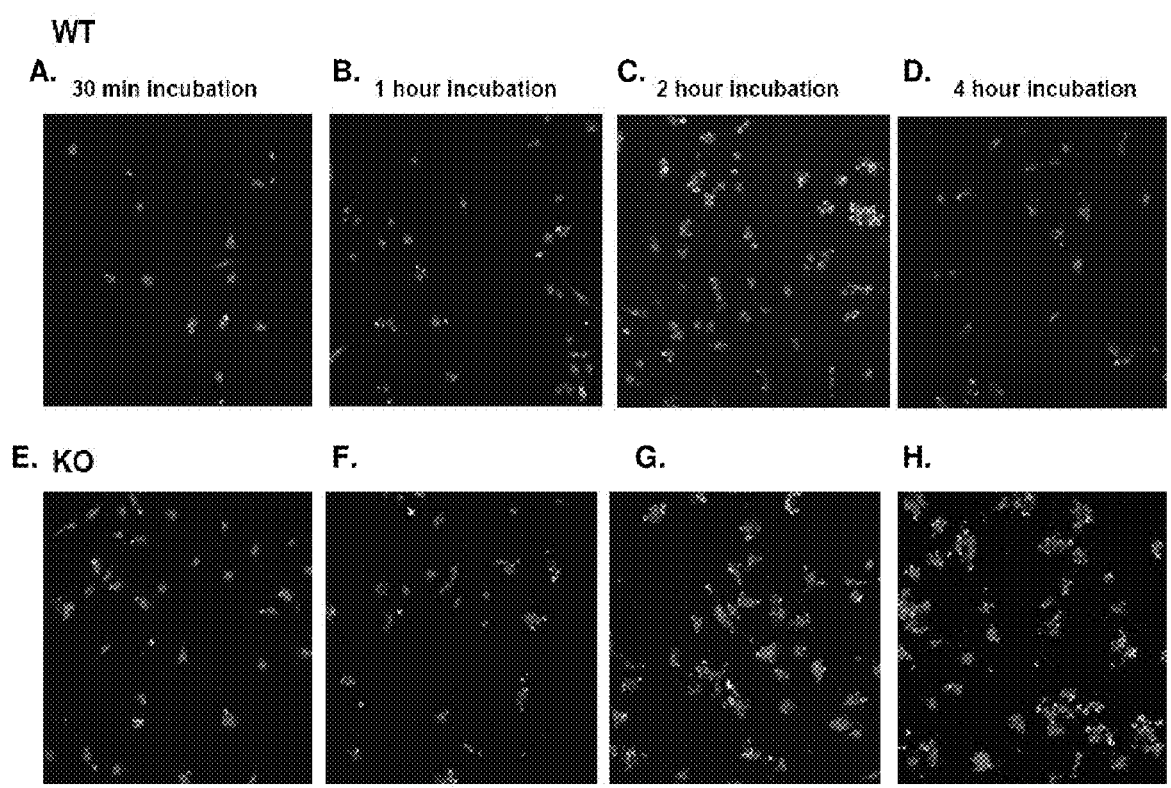
FIGS. 7A-7H. The binding, endocytosis, and clearance of apoptotic thymocytes by peritoneal macrophages from wild type (WT) mice (FIGS. 7A-7D) and knockout (KO) mice (FIGS. 7E-7H). Time dependent changes in endocytosed thymocytes were detected by anti-CD68 (red) and TUNEL assay (green).
Figure 8:
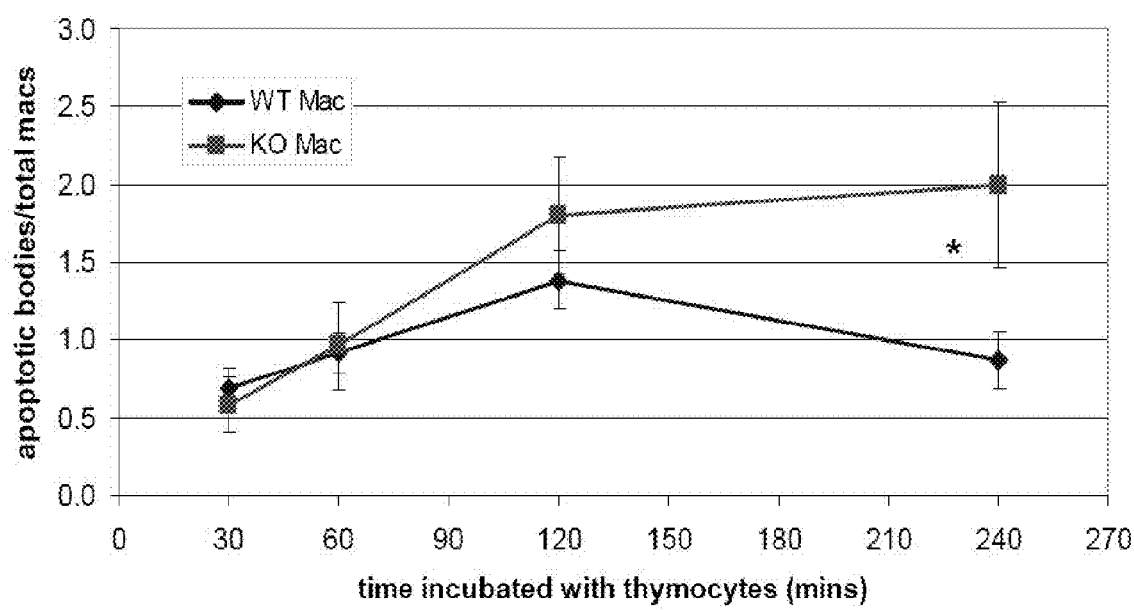
FIG. 8. Phagocytic index of macrophages from WT and KO mice, as measured by the number of apoptotic bodies/macrophage. The graphed values represent the mean+/31 SD (n=8) per time point. * denotes p<0.05.

Peritoneal macrophages were obtained following intraperitoneal thioglycolate injection of 1 year old wild type and null mice. Thymocytes were harvested and apoptosis induced by 24 hour treatment with dexamethasone. LPLA2+/+ (WT) and LPLA2−/− (KO) macrophages were incubated with wild type apoptotic thymocytes for 0.5, 1, 2, and 4 hours. After incubation, the plates were washed and the residual apoptotic bodies were measured by co-staining of the macrophages with anti-CD68 and TUNEL (FIG. 7A-7H). No differences were observed in the rate of uptake or of the peak number of apoptotic bodies incorporated between the wild type and null macrophages. However, a marked difference was observed in the persistence of apoptotic bodies in the LPLA2−/− macrophages at 4 hours (FIG. 7H). When expressed as a phagocytic index, a highly significant difference was observed between the wild type and null macrophages (FIG. 8).

Figure 9:
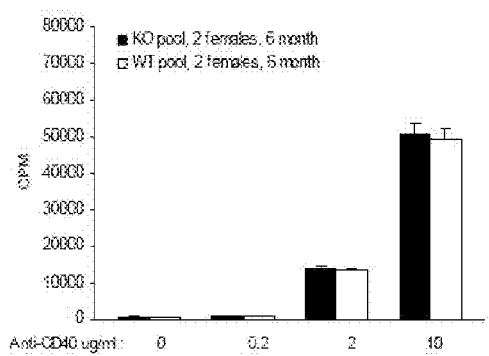
FIGS. 9A-9D. B and T cell proliferation studies in 6 or 8 month old WT and KO mice.
Figure 9:
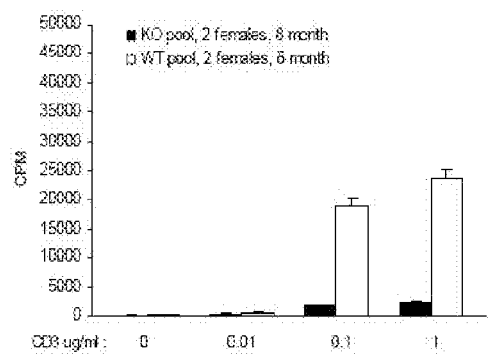
Figure 9:
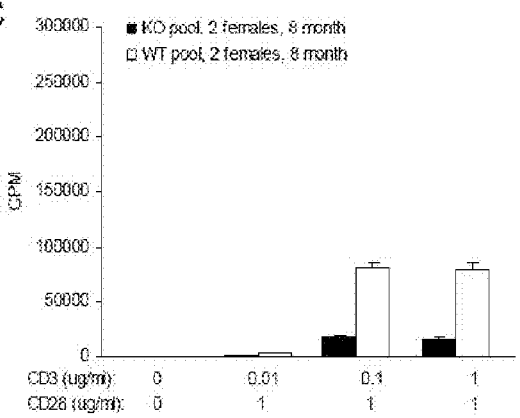
Figure 9:
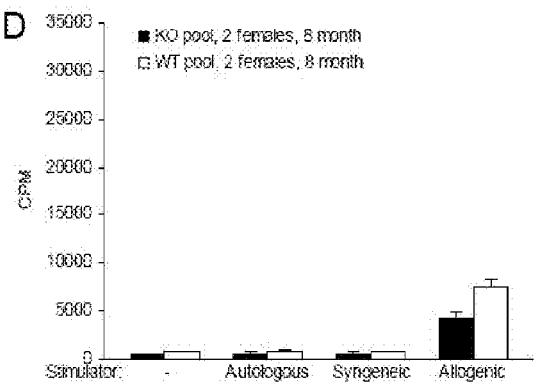

B and T cell stimulation assays were used to ascertain whether differences exist in the responsiveness between LPLA2−/− and LPLA2+/+ mice. B and T cells were isolated from the spleens of 8 month old female mice and stimulated with antibodies to CD40 (FIG. 9A), CD3 (FIG. 9B), and CD3 and CD28 (FIG. 9C) in order to measure B cell stimulation, T cell stimulation, or T cell co-stimulation respectively. Cell proliferation was measured by tritiated thymidine incorporation 3 days following isolation and stimulation. No difference was observed in B cell responsiveness to CD40. However, the LPLA2−/− T cells were less responsive to both direct stimulation with CD3 and co-stimulation with CD3 and CD28 (FIGS. 9B and 9C). This latter response is opposite to that reported in the G2A knockout mouse. Mixed lymphocyte reaction (MLR) assays were also performed using autologous, syngeneic, and allogeneic stimulators (FIG. 9D). The LPLA2−/− response to allogeneic stimulation was significantly less than that observed in the wild type T cells. This may be significant in that several studies have been reported demonstrating a decrease in MLR activity in lupus patients (Kuntz et al., J Clin Invest. 63(1):151-153, 1979).

EXAMPLE 3

LPLA2 is Secreted from Macrophages Following Activation and is Reincorporated into Macrophages Via a Mannose Receptor LPLA2 has been reported to be secreted from macrophages following activation by ligand (Abe et al., J Immunol 181: 7873-7881, 2008). For example, the binding and phagocytosis of zymosan result in the time dependent release of LPLA2 from alveolar macrophages.

The ability of macrophages from LPLA2−/− mice to recognize, endocytose, and traffic recombinant LPLA2 was studied as follows. LPLA2 null alveolar macrophages were exposed to His-tagged mouse LPLA2 for 1 day at concentrations varying between 0.3 and 10 μg/ml. Cell incorporation was measured by Western blotting and confocal microscopy using either anti-His antibody or a monoclonal antibody raised to LPLA2. A concentration dependent increase in cellular LPLA2 was easily detected and confirmed by enzyme activity measurements. When treated cells were stained with both anti-LPLA2 and Lamp-1 antibodies, co-localization of the recombinant enzyme and the lysosome protein were readily detected.

To ascertain whether the recognition and incorporation of the recombinant LPLA2 was through recognition by a mannose versus mannose-phosphate receptor, the incorporation experiments were repeated in the presence of either 10 mM α-methyl-mannoside or 10 mM mannose-6-phosphate. α-Methyl-mannoside but not mannose-6-phosphate blocked the incorporation of LPLA2 as measured by cellular 1-O-acyl-ceramide synthase activity, immunoblotting, and confocal microscopy. Finally, the ability of the recombinant enzyme to "rescue" the cellular phenotype was confirmed by measuring the cellular phospholipid content. A concentration dependent decrease in cell phosphatidylcholine and phosphatidylethanolamine was observed. Catalytically inactive enzyme did not lower the phospholipid levels.

Collectively, these data confirm that LPLA2 is secreted by macrophages in response to zymosan and once secreted can be reclaimed through a mannose receptor dependent process. These data also raise the possibility that a primary mode of action of LPLA2 may be the degradation of extracellular phospholipids to form free fatty acids and lyso-PC and lyso-PE.

EXAMPLE 4

Cationic Amphiphlic Drugs Inhibit LPLA2 Activity and Result in Cellular Phospholipidosis Ceramide analogue 1-phenyl-2-decanoylamino-3-morpholino-1-propanol (PDMP) has been observed to inhibit acidic transacylation of ceramide localized to the lysosomal fraction of cells. PDMP is structurally similar to drugs that are chemically characterized as cationic amphiphilic drugs. The possibility that such cationic amphiphilic drugs might cause cellular phospholipidosis through a comparable mechanism was tested as follows.

Figure 10:
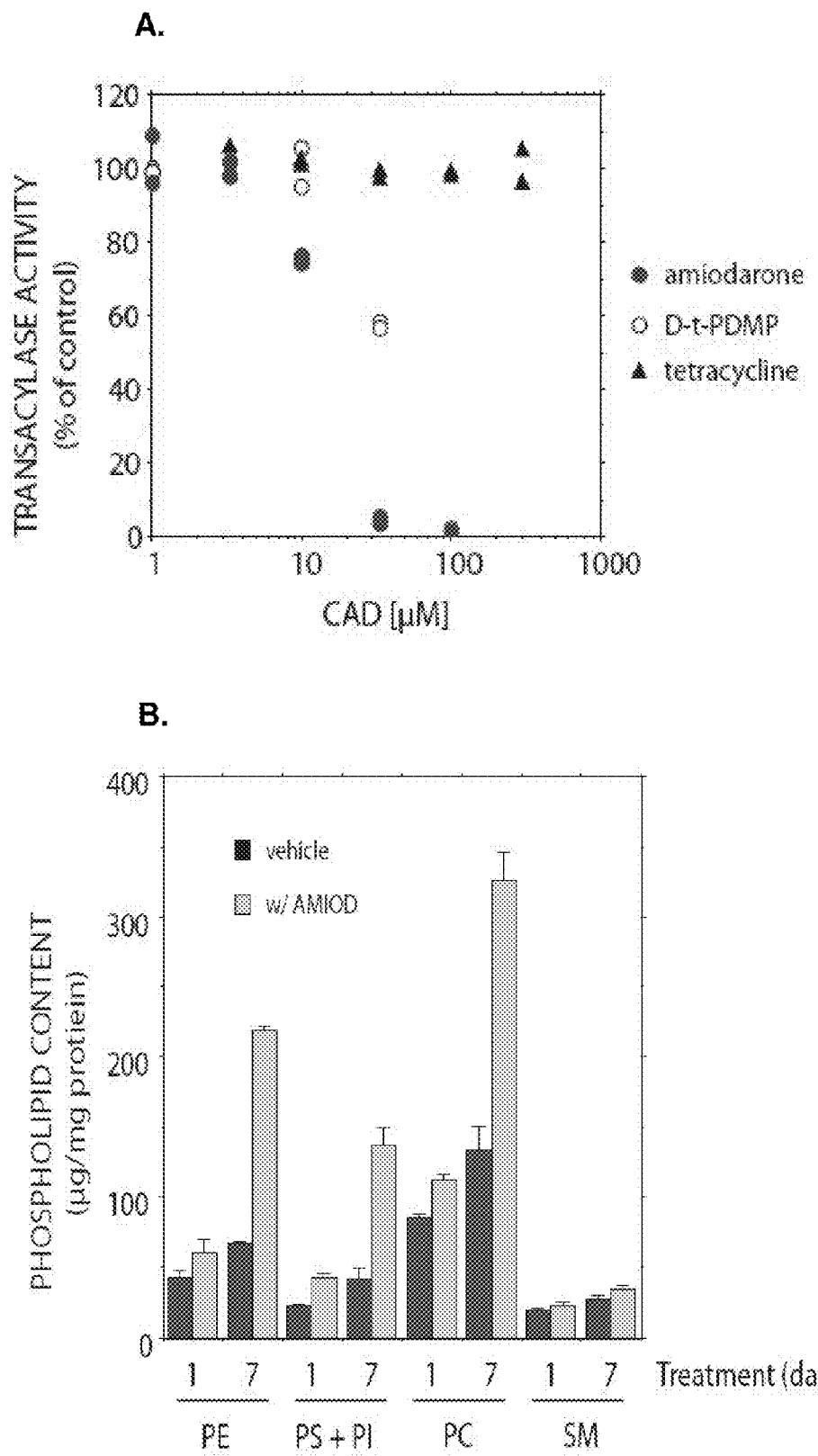
FIGS. 10A-10B. Effects of the cationic amphiphilic drugs PDMP and amiodarone on 1-O-acylceramide synthase activity (FIG. 10A) and cellular phospholipids content (FIG. 10B).

MDCK cells were treated for 1 or seven days with the cationic amphiphilic drugs PDMP, amiodarone, and tetracycline. LPLA2 activity was measured as the transacylation of N-acetylsphingosine. Amiodarone is a prototypic agent that causes phospholipidosis (and SLE); tetracycline has no known association with either lupus or phospholipidosis. Amiodarone and PDMP were both associated with a concentration dependent inhibition of LPLA2 activity as measured by ceramide transacylation (FIG. 10A). Amiodarone and PDMP but not tetracycline displayed comparable IC50s for enzyme inhibition. Tetracycline was without inhibitory effect. Amiodarone treatment also resulted in a time dependent increase in cell phospholipids, most notably PC and PE. The major cellular phospholipids were assayed following 1 or 7 days of exposure to the CAD. Highly significant changes in the LPLA2 substrates PE and PC were observed by 7 days of treatment but no changes in sphingomyelin (SM) were observed (FIG. 10B).

The inhibition of LPLA2 activity by amiodarone and other cationic amphiphiles could have resulted from the direct binding of these drugs to the enzyme through a competitive or non-competitive effect. An alternative mechanism was considered, the disruption of the electrostatic interaction between LPLA2 and the anionic lysosomal membrane. Lysosomal membranes are characterized by the presence of lyso-bis-phosphatidic acid, an anionic phospholipid found exclusively in acidic cellular organelles most notably the late endosome and lysosome.

Figure 11:
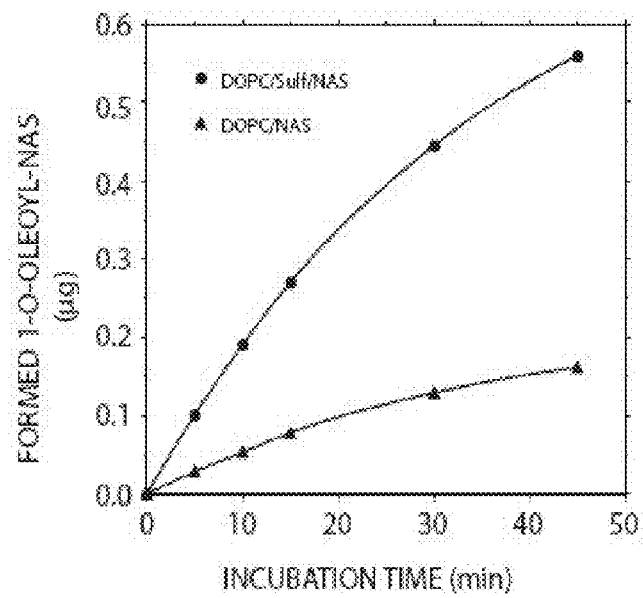
FIGS. 11A-11B. Effect of negatively charged lipid on LPLA2 activity. Liposomes consisting of Di-octanoyl-PC (DOPC)/N-acetylsphingosine (NAS) or DOPC/sulfatide/NAS were incubated with LPLA2 enzyme, and the reaction product, 1-O-oleoyl-NAS was plotted against time (FIG. 11A). Liposomes consisting of DOPC/galactosylceramide/NAS or DOPC/sulfatide/NAS with different molar ratios of sulfatide were incubated with LPLA2 enzyme, and the reaction product, 1-O-oleoyl-NAS was plotted against molar ratio.
Figure 11:
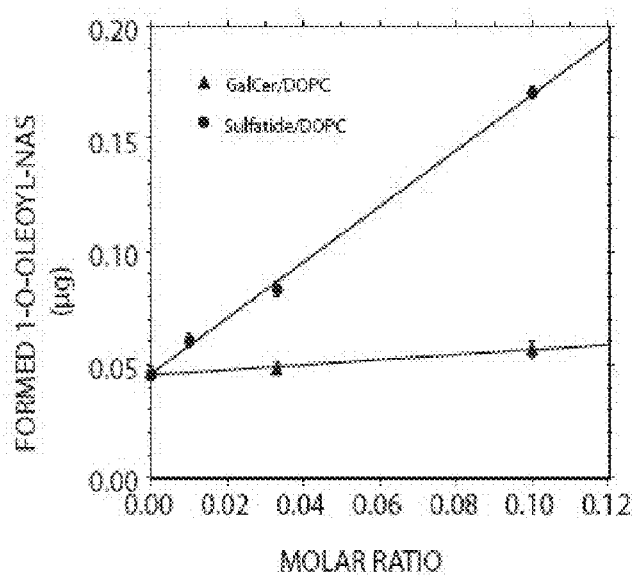

To address this possibility, the 1-O-acylceramide synthase activity of LPLA2 was studied in liposomes in which the anionic lipid content was varied by the addition of sulfatide, a negatively charged, sulfate containing glycolipid that is not a substrate for LPLA2. Di-octanoyl-PC (DOPC) was used as the liposomal substrate. The reaction mixture contained 48 mM sodium citrate (pH 4.5), 10 µg/ml BSA, liposomes (127 µM phospholipid) and 14.5 ng/ml of recombinant mouse LPLA2 in 500 µl of total volume. Liposomes consisting of DOPC/NAS (3:1, molar ratio) or DOP/sulfatide/NAS (3:0.3:1, molar ratio) were incubated with the enzyme for 5, 10, 15, 30 and 45 min at 37° C. The reaction products were extracted and separated by an HPTLC plate using a solvent system consisting of chloroform/acetic acid (9:1, v/v). The reaction product, 1-O-oleoyl-NAS, quantified by scanning the plate, was plotted against time (FIG. 11A). Liposomes consisting of DOPC/galactosylceramide/NAS or DOPC/sulfatide/NAS with a different molar ratio were incubated with the recombinant enzyme at 37° C. (FIG. 11B). A time dependent increase in the transacylation activity was observed in the presence of sulfatide (FIGS. 11A and 11B) which increased as a function of the molar ratio of sulfatide.

EXAMPLE 5

Cationic Amphiphilic Drugs Interfere with the Electrostatic Interactions Between LPLA2 and Anionic Lipid Membranes The effects of ionic strength, pH and amiodarone on LPLA2 enzymatic activity and on the electrostatic interaction between LPLA2 and liposomes were determined.

Figure 12:
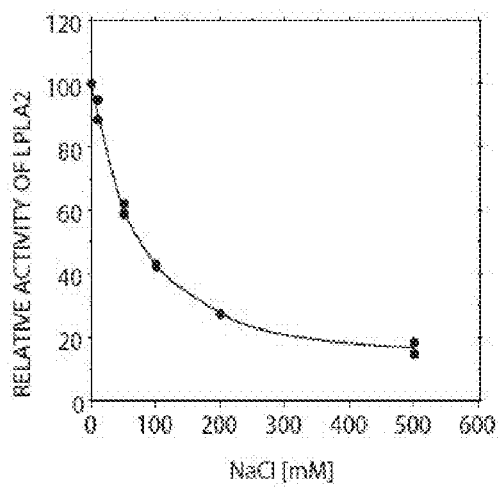
FIG. 12A. Effect of ion strength on LPLA2 activity. 1-O-oleoyl-NAS plotted against NaCl concentration (mM).
FIG. 12B. Effect of pH on LPLA2 activity. 1-O-oleoyl-NAS plotted against pH.
FIG. 12C. Effect of cationic amphiphilic drug on LPLA2 activity. Liposomes consisting of DOPC sulfatide and NAS were pre-incubated with different concentrations of a cationic amphiphilic drug, amiodarone and then incubated with LPLA2 enzyme. 1-O-oleoyl-NAS plotted against concentration of drug (μM).
Figure 12:
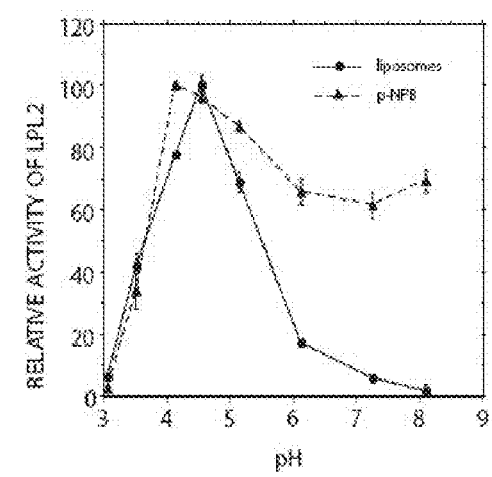
Figure 12:
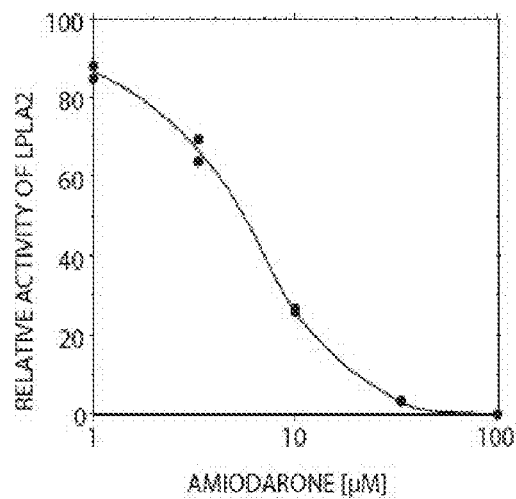

The reaction mixture contained 0-500 mM NaCl, 48 mM sodium citrate (pH 4.5), 10 µg/ml BSA, liposomes (127 µM phospholipid) and either 14.5 ng/ml of recombinant mouse LPLA2 (+) or 7.8 µg protein/ml of the soluble fraction obtained from MDCK cells transfected with mouse LPLA2 (+) in 500 µl of total volume. Before starting the reaction, liposomes consisting of DOPC, sulfatide and NAS (3:0.3:1, molar ratio) were pre-incubated for 5 min at 37° C. The reaction was initiated by adding the recombinant LPLA2 and carried out at 37° C. The reaction products were extracted and separated by an HPTLC plate using a solvent system consisting of chloroform/acetic acid (9:1, v/v). One of the products, 1-O-oleoyl-NAS, quantified by scanning the plate, was plotted against NaCl concentration (FIG. 12A). Liposomes consisting of DOPC sulfatide and NAS were pre-incubated with a different concentration of cationic amphiphilic drug, amiodarone, for 5 min at 37° C. and then incubated with the recombinant LPLA2 (FIG. 12C). The reaction was carried out in sodium citrate/sodium phosphate buffer with various pH (FIG. 12B).

As one would predict for an enzyme-liposome interaction that was dependent on electrostatic interactions, increasing either the NaCl concentration or pH of the reaction mixture significantly inhibited the transacylase activity of the enzyme (FIGS. 12A and 12B). Importantly, if the LPLA2 activity was simply measured as an esterase using the water soluble substrate p-nitro-phenylbutyrate (ρ-NPB) in the absence of liposomes, the pH dependence was largely lost. Increasing the concentration of amiodarone, a classic cationic amphiphilic drug, similarly inhibited the enzyme activity (FIG. 12C).

Figure 13:
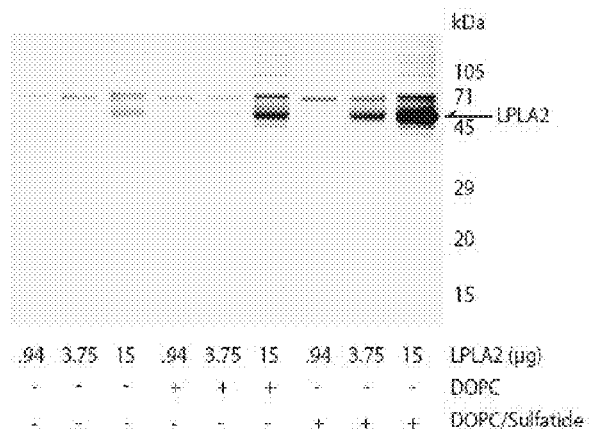
FIG. 13A-13C. Co-sedimentation of LPLA2 with liposomes. Liposomes consisting of DOPC or DOPC/sulfatide were incubated with varying amounts of LPLA2 and the reaction product was separated by SDS-PAGE (FIG. 13A). Liposomes consisting of DOPC, DOPC/sulfatide or glactosylceramide (GalCer) were incubated with LPLA2 and the reaction product was analyzed by SDS-PAGE (FIG. 13B). Liposomes consisting of DOPC or DOPC/sulfatide were incubated with LPLA2 at varying pH with or without NaCl or amiodarone (AMIOD) and the reaction product was analyzed by SDS-PAGE.
Figure 13:
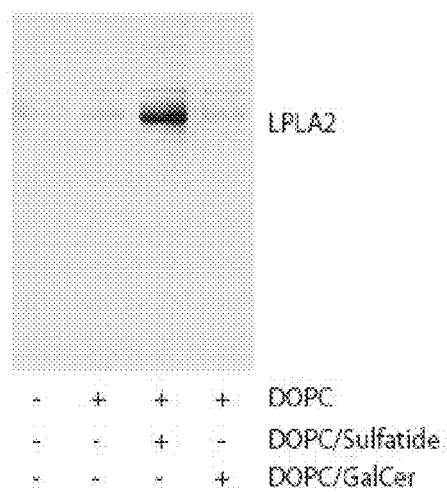
Figure 13:
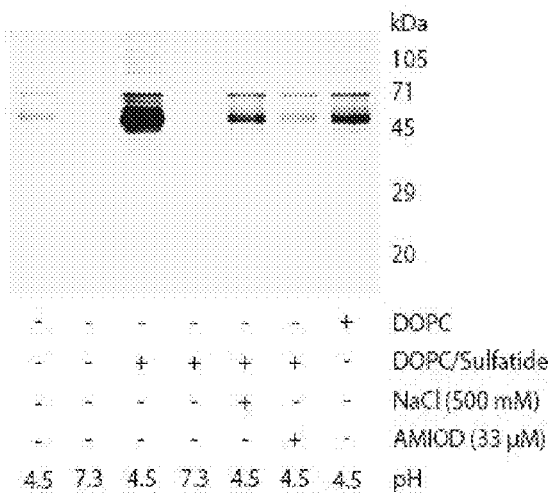

In order to determine whether the disruption of the electrostatic interaction between LPLA2 and the liposome could be measured as a physical interaction, co-sedimentation of the enzyme and liposomes was detected after high speed ultracentrifugation and separation by SDS-PAGE while the ionic strength, pH, and presence of amiodarone were varied. Liposomes consisting of DOPC or DOPC/sulfatide (10:1, molar ratio) were incubated with varying amounts of recombinant mouse LPLA2 in 500 µl of 48 mM Na-citrate (pH 4.5) for 30 min on ice (FIG. 13A). Liposomes consisting of DOPC, DOPC/sulfatide (10:1, molar ratio) or DOPC/galactosylceramide (10:1, molar ratio) were incubated with 4 µg of the recombinant LPLA2 or 16 µg of the recombinant LPLA2 with or without 500 mM NaCl or 33 µM amiodarone (FIGS. 13B and 13C). The reaction mixtures were centrifuged for 1 h at 150,000 g at 4° C. The concentration of DOPC in these assays was 127 µM. The resultant precipitates were briefly washed with cold 50 mM Na-citrate (pH 4.5) and dissolved with 40 µl of SDS-polyacrylamide gel electrophoresis sampling buffer. The samples were separated by using 12% SDS-polyacrylamide gel. After electrophoresis, LPLA2 was detected by staining with CBB.

The physical association between LPLA2 and liposomes was increased in the presence of sulfatide (FIG. 13B) and was inhibited with higher pH, NaCl concentration, or the presence of amiodarone (FIG. 13C). These data indicate that cationic amphiphilic drugs inhibit LPLA2 activity by interfering with the electrostatic interactions between LPLA2 and anionic lipid membranes.

EXAMPLE 6

LPLA2 Gene Expression is Decreased in the Glomeruli of Lupus Patients Compared to Patients with Other Glomerular Diseases To determine whether the expression of LPLA2 differed between patients with lupus and patients with other forms of glomerular disease, gene expression profiles from patients were analyzed. The Division of Nephrology at the University of Michigan contains the Applied Systems Biology Core Laboratory. This group has biobanked and analyzed the gene expression profiles of renal biopsies from patients with a variety of renal disorders obtained from centers in Europe and the United States. Control biopsy specimens are obtained from healthy kidney donors at the time of transplantation. At the time of biopsy, the glomerular and tubulointerstial compartments are separated by microdissection and the mRNA profiles obtained. Analysis using statistical analysis by microarray (SAM) revealed a significantly lower expression level in lupus glomeruli compared to controls or biopsies from patients with diabetes, IgA nephropathy, minimal change disease, or hypertensive nephrosclerosis (Table 2).

|  | Fold Change SAM | q-value |
|---|---|---|
| SLE (glom) n = 32 | 0.857 | 0.009 |
| SLE (ti) n = 32 | 1.023 | 0.198 |
| IgA (glom) n = 27 | 1.086 | 0.293 |
| IgA (ti) n = 25 | 1.236 | 0.087 |
| MCD (glom) n = 6 | 1.142 | 0.336 |
| MCD (ti) n = 5 | 1.012 | NS |
| Early DM (glom) n = 22 | 1.329 | 0.001 |
| Early DM (ti) n = 22 | 0.970 | 0.242 |
| Prog DM (glom) n = 7 | 0.116 | 0.552 |
| Prog DM (ti) n = 7 | 1.040 | 0.526 |
| HTN (glom) n = 15 | 1.198 | 0.058 |
| HTN (ti) n = 20 | 1.191 | 0.407 | mRNA expression profiles were obtained from five different glomerular diseases including early and progressive diabetic nephropathy (DM), IgA nephropathy, minimal change disease (MCD) and hypertensive nephrosclerosis (HTN). mRNA was obtained from renal biopsies representing a 5 mm core cortical sample from patients with a range of estimated GFRs and in whom the diagnosis was established by pathological investigation by light and electron microscopy. Biopsies were micro-dissected into glomerular (g) and tubulointerstitial (ti) compartments. The mRNA profiles were obtained using published protocols with an inter-array reproducibility above 0.98. RNA amplification ensured probe set detection independent of the number of glomeruli isolated. Data stored in the ASBC was processed in a standardized open-source analysis pipeline, Genepattern, to generate gene expression maps. LPLA2 expression was compared between different glomerular diseases and analyzed using significance analysis of microarrays (SAM) (Lorz et al., J Am Soc Nephrol. 19(5):904-14, 2008). Significance was expressed as a q value which accounts for the false discovery rate of multiple samples.

These data show that mRNA expression of LPLA2 is decreased in the microdissected glomeruli of patients with lupus, compared to the glomeruli of normal controls and glomeruli of patients with glomerular disease secondary to diabetes, hypertensive nephrosclerosis, minimal change disease, and IgA nephropathy.

EXAMPLE 7

Assays for LPLA2 Activity and Autoantibodies in Human Serum

LPLA2 null mice and G2A null mice are indistinguishable with the exception of the development of foam cells in the former knockout model. The inability to locally produce either lyso-phosphatidylcholine or free fatty acid in the lymph node or spleen germinal centers may represent the mechanistic link between these two models of lupus. Alternatively, LPLA2 may represent the first gene product identified as required for the digestion of apoptotic bodies.

SLE represents a complex clinical syndrome. The lupus syndrome may be comprised of a number of mechanistically distinct but phenotypically similar diseases. LPLA2 represents a newly described lysosomal protein that is the long sought acidic, secreted phospholipase A2. The loss of this activity in mice results in a very strong phenotype that mimics many of the clinical features of lupus. Furthermore, an analysis of the plasma lysosomal protein proteome reveals that LPLA2 circulates in human circulation. In order to test whether a loss of LPLA2 activity is a marker of active lupus, serum assays were first developed for LPLA2 activity and for autoantibodies to LPLA2.

A. Serum Lysosomal Phospholipase A2 Assay

LPLA2 activity is distinct from that of other known phospholipase A2s based on two primary properties. First, the enzyme displays an acidic pH optimum of 4.5 and has little detectable activity of pH 7.4. Second, the enzyme acts both as a phospholipase A2 and as a transacylase. N-acetyl-sphingoline (NAS, C2 ceramide) is a preferred lipophilic acceptor for the enzyme. Thus the formation of the fatty acyl ester of C2 ceramide, 1-O-acyl-N-acetyl-sphingosine, provides a highly specific measure of activity and is the principle behind the proposed assay to be used (Shayman, J. A., and Abe, A. Methods Enzymol 311, 105-117, 2000).

To date, LPLA2 assays have been restricted to recombinant enzyme, cultured cells, cell culture supernatants, and tissue homogenates. Several factors may affect the recovery and measurement of LPLA2 in plasma or serum and will need to be explored in the process of validating this assay.

The following assay for the enzyme is designed to determine whether LPLA2 circulates as a free protein or bound protein, whether cofactors in plasma or serum modulate LPLA2 activity, whether there are additional enzymes that metabolize the products of LPLA2 activity found in plasma or serum, and whether there endogenous lipids in plasma or serum that will compete with the assay substrate and thereby inhibit LPLA2 activity.

The phospholipids DOPC and phosphatidylethanolamine (PE) along with NAS are used in the assay system as donor and acceptor, respectively, of an acyl group. The transacylase activity is determined by analysis of the 1-O-acyl-N-acetyl-sphingosine formation rate. The reaction mixture consist of 45 mM sodium citrate (pH 4.5), 10 μg/ml bovine serum albumin, 40 μM NAS incorporated into phospholipid liposomes (DOPC/PE/dicetyl phosphate/NAS (5:2:1:2 in molar ratio)), and a soluble fraction (0.7-10 μg) in a total volume of 500 μl. The reaction is initiated by adding the serum or plasma sample, kept for 5-6 min. at 37° C., and terminated by adding 3 ml of chloroform/methanol (2:1) plus 0.3 ml of 0.9% (w/v) NaCl. The mixture is centrifuged for 5 min at room temperature. The resultant lower layer is transferred into another glass tube and dried down under a stream of nitrogen gas. The dried lipid, dissolved in 40 μl of chloroform/methanol (2:1) is applied on a high performance thin layer chromatography plate and developed in a solvent system consisting of chloroform/acetic acid (9:1). The plate was dried down and soaked in 8% (w/v) $CuSO_4$, $5H_2O$, 6.8% (v/v) $H_3PO_4$, and 32% (v/v) methanol. The uniformly wet plate is briefly dried down by a hair dryer and charred for 15 min. in a 150° C. oven. The plate is scanned, and the chemical mass of the reaction products are estimated by the NIH Image version 1.62.

The potential effects of cofactors, protein binding, interfering lipids, or metabolism of product is evaluated by a number of experiments. These include determining the formation of product over time and as a function of sample size.

In addition, serum samples can be "spiked" with known amounts of authentic, recombinant LPLA2 to ascertain if interfering substances are present. Recombinant LPLA2 can also be assayed in the presence of albumin or lipoprotein to determine whether these interfere with the assay. The enzyme activity is expressed as amoles 1-O-acyl-NAS formed per ml serum per minute. The activities in human serum and plasma are compared as well as the reproducibility of the assay in the same sample with repeated measurements over time. The effects of storage, heparin, calcium, chelation, and freeze thawing are additional factors that are evaluated.

B. Serum Assay for Lysosomal Phospholipase A2 Autoantibodies

The following protocol is employed for the measurement of autoantibodies to LPLA2. Recombinant LPLA2 (0.1 to 0.5 μg in 50 μl PBS per well) is absorbed onto microtiter plate wells by overnight incubation of 4° C. The plates are washed 4 times with PBS/0.1% TWEEN™. The plates are then blocked for 1 hour with 50 μl of PBS with 10 mg/ml bovine serum albumin. Wells are washed with the PBS/TWEEN™ solution and then serum samples or controls are added for 2 hours at room temperature and then overnight at 4° C. The wells are washed again with PBS/TWEEN™ and then a secondary anti-human IgG antibody is added for 2 hours at room temperature. Following the same washing step, detection utilizes O-phenylenediamine dihydrochloride as substrate for horseradish peroxidase. Plate well absorbance is read at 492 nm.

Important variables to establish include whether the serum samples require dilution, whether the LPLA2 used for coating the plates should be denatured with carbonate buffer (pH 9.6, 0.05 M), and whether the serum samples should be similarly denatured with carbonate buffer.

The reproducibility of detecting antibodies present, the effects of serum freezing and storage, and the potential effects of interfering substances on the assay are variables that will be considered in the validation of this assay.

EXAMPLE 8

LPLA2 Activity and Autoantibody Titers in Bio-Banked Serum Samples and Correlation of the Clinical Profiles to the SLE Disease Activity Index The Michigan Lupus Cohort (MLC) is a dynamic, prospective cohort of SLE patients receiving ongoing care at the University of Michigan. The MLC was established in the year 2000 and currently includes over 600 patients (90% female; 79% white, 17% black, 1% Hispanic, 2% Asian/Pacific Islander, 1% other). Cohort participants sign informed consent which enables systematic follow up of clinical, social and demographic data. Detailed laboratory and clinical data, including prospective assessment of disease activity (SLE-DAI score) (Bombardier, C. et a. Arthritis Rheum 35, 630-640, 1992), are collected at each clinic visit, which typically occurs at three month intervals. A repository of blood samples (which are collected in association with most clinic visits) has also been prospectively generated since start of the MLC. The MLC also serves as a screening and recruiting tool for SLE protocols, and has facilitated numerous collaborations and ancillary projects.

The MLC is the source of patient sera and clinical data for measurement of LPLA2 activity and auto antibody titers. The longitudinal nature and richness of the clinical data make this an exceptionally valuable resource for this study. Sera is assayed from every patient currently participating in the MLC. These assays are performed in a blinded fashion ion and samples are randomly assayed without regard for disease activity or clinical phenotype. Age and gender matched samples from healthy patients as well as those with the absence of autoimmune disease (e.g. osteoarthritis) are studied as controls. Based on these measurements, a normal range for LPLA2 activity is determined. For patients identified that either exhibit significantly lower activities of LPLA2 compared to controls or the presence of significant titers of anti-LPLA2 antibodies, a comprehensive evaluation of their clinical phenotypes is undertaken. A significant number of MLC patients exhibiting low LPLA2 activity or elevated anti-LPLA2 demonstrate a statistically significant association between these findings and the presence of a particular clinical phenotype (e.g. lymphadenopathy) or laboratory finding (e.g., anti-phospholipid antibodies). For those patients that are found to have positive findings, a retrospective determination of LPLA2 activity and antibody titer is made on all samples available to investigate a correlation with disease activity. The potential association between gender and LPLA2 activity and auto-antibody titers is also evaluated.

EXAMPLE 9

LPLA2 Activity in an Animal Model

Human or mammalian LPLA2 enzyme, or a variant or derivative thereof is tested in an animal model exhibiting an accumulation of tingible body macrophages are known, e.g., LPLA2−/− knockout mouse model. Other mouse models in which such agents are tested for ability to reduce accumulation of intracellular tingible body macrophages or reduce other signs and symptoms of autoimmune disease include: the Ro mouse model (Xue et a., Proc Natl Acad Sci U S A 100: 7503-7508, 2003), the Tyro 3 mouse model (Lu et a., Science 293: 306-311, 2001), the c-mer mouse model (Cohen et al., J Exp Med 196: 135-140, 2002), and the MFG-E8 mouse model (Hanayama et al., Science 304: 1147-1150, 2004).

The references cited herein throughout, to the extent that they provide exemplary procedural or other details supplementary to those set forth herein, are all specifically incorporated herein by reference.

SEQUENCE LISTING (291 sequences)

SEQ ID NO: 1 - protein, 412 aa, Homo sapiens
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 2 - protein, 123 aa, Ovis aries
ALWQFNGMIKCKIPSSEPLLDFNNYGCYCGLGGSGTPVDDLDRCCQTHDNCYKQAKKLDSCKVLVDNPYTNSYSYSCSNKQITCSSENNACEAFICNCDRNAAICFSEVPYNNEHKNLDKKYC

SEQ ID NO: 3 - protein, 146 aa, Rattus norvegicus
MKVLLLLAVVIMAFGSIQVQGSLLEFGQMILFKTGKRADVSYGFYGCHCGVGGRGSPKDATDWCCVTHDCCYNRLEKRGCGTKFVTYKFSYRGGQISCSTNQDSCRKQLCQCDKAAAECFARNKKSYSLKYQFYPNKFCKGKTPSC

SEQ ID NO: 4 - protein, 749 aa, Homo sapiens
MSFIDPYQHIIVEHQYSHKFTVVVLRATKVTKGAFGDMLDTPDPYVELFISTTPDSRKRTRHFNNDINPVWNETFEFILDPNQENVLEITLMDANYVMDETLGTATFTVSSMKVGEKKEVPFIFNQVTEMVLEMSLEVCSCPDLRFSMALCDQEKTFRQQRKEHIRESMKKLLGPKNSEGLHSARDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQSRGSTMEEELENITTKHIVSNDSSDSDDESHEPKGTENEDAGSDYQSDNQASWIHRMIMALVSDSALFNTREGRAGKVHNFMLGLNLNTSYPLSPLSDFATQDSFDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDMEKDCPTIIHFVLANINFRKYKAPGVPRETEEEKEIADFDIFDDPESPFSTFNFQYPNQAFKRLHDLMHFNTLNNIDVIKEAMVESIEYRRQNPSRCSVSLSNVEARRFFNKEFLSKPKA

SEQ ID NO: 5 - protein, 1487 aa, Mus musculus
MVQWLAMLQLLWLQQLLLLGIHQGIAQDLTHIQEPSLEWRDKGIFIIQSESLKTCIQAGKSVLTLENCKQPNEHMLWKWVSDDHLFNVGGSGCLGLNISALEQPLKLYECDSTLISLRWHCDRKMIEGPLQYKVQVKSDNTVVARKQIHRWIAYTSSGGDICEHPSRDLYTLKGNAHGMPCVFPFQFKGHWHHDCIREGQKEHLLWCATTSRYEEDEKWGFCPDPTSMKVFCDATWQRNGSSRICYQFNLLSSLSWNQAHSSCLMQGGALLSIADEDEEDFIRKHLSKVVKEVWIGLNQLDEKAGWQWSDGTPLSYLNWSQEITPGPFVEHHCGTLEVVSAAWRSRDCESTLPYICKRDLNHTAQGILEKDSWKYHATHCDPDWTPFNRKCYKLKKDRKSWLGALHSCQSNDSVLMDVASLAEVEFLVSLLRDENASETWIGLSSNKIPVSFEWSSGSSVIFTNWYPLEPRILPNRRQLCVSAEESDGRWKVKDCKERLFYICKKAGQVPADEQSGCPAGWERHGRFCYKIDTVLRSFEEASSGYYCSPALLTITSRFEQAFITSLISSVAEKDSYFWIALQDQNNTGEYTWKTVGQREPVQYTYWNTRQPSNRGGCVVVRGGSSLGRWEVKDCSDFKAMSLCKTPVKIWEKTELEERWPFHPCYMDWESATGLASCFKVFHSEKVLMKRSWREAEAFCEEFGAHLASFAHIEEENFVNELLHSKFNWTQERQFWIGFNRRNPLNAGSWAWSDGSPVVSSFLDNAYFEEDAKNCAVYKANKTLLPSNCASKHEWICRIPRDVRPKFPDWYQYDAPWLFYQNAEYLFHTHPAEWATFEFVCGWLRSDFLTIYSAQEQEFIHSKIKGLTKYGVKWWIGLEEGGARDQIQWSNGSPVIFQNWDKGREERVDSQRKRCVFISSITGLWGTENCSVPLPSICKRVKIWVIEKEKPPTQPGTCPKGWLYFNYKCFLVTIPKDPRELKTWTGAQEFCVAKGGTLVSIKSELEQAFITMNLFGQTTNVWIGLQSTNHEKWVNGKPLVYSNWSPSDIINIPSYNTTEFQKHIPLCALMSSNPNFHFTGKWYFDDCGKEGYGFVCEKMQDTLEHHVNVSDTSAIPSTLEYGNRTYKIIRGNMTWYAAGKSCRMHRAELASIPDAFHQAFLTVLLSRLGHTHWIGLSTTDNGQTFDWSDGTKSPFTYWKDEESAFLGDCAFADTNGRWHSTACESFLQGAICHVVTETKAFEHPGLCSETSVPWIKFKGNCYSFSTVLDSRSFEDAHEFCKSEGSNLLAIRDAAENSFLLEELLAFGSSVQMVWLNAQFDNNNKTLRWFDGTPTEQSNWGLRKPDMDHLKPHPCVVLRIPEGIWHFTPCEDKKGFICKMEAGIPAVTAQPEKGLSHSIVPVTVTLTLIIALGIFMLCFWIYKQKSDIFQRLTGSRGSYYPTLNFSTAHLEENILISDLEKNTNDEEVRDAPATESKRGHKGRPICISP

SEQ ID NO: 6 - protein, 144 aa, Homo sapiens
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 7 - protein, 752 aa, Rattus norvegicus
MSFIDPYQHIIVEHQYSHKFTVVVLRATKVTKGTFGDMLDTPDPYVELFISTTPDSRKRTRHFNNDINPVWNETFEFILDPNQENVLEITLMDANYVMDETLGTATFPVSSMKVGEKKEVPFIFNQVTEMILEMSLEVCSCPDLRFSMALCDQEKTFRRQRKENIKENMKKLLGPKKSEGLYSTRDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIQNRMSTTLSSLKEKVSAARCPLPLFTCLHVKPDVSELMFADWVEFSPYEIGMAKYGTFMTPDLFGSKFFMGTVVKKYEENPLHFLMGVWGSAFSILFNRVLGVSGSQNKGSTMEEELENITAKHIVSNDSSDSDDEAQGPKGTENEDAEREYQNDNQASWVHRMLMALVSDSALFNTREGRAGKEHNFMLGLNLNTSYPLSPLRDFSPQDSFDDDELDAAVADPDEFERIYEPLDVKSKKIHVVDSGLTFNLPYPLILRPQRGVDLIISFDFSARPSDTSPPFKELLLAEKWAKMNKLPFPKIDPYVFDREGLKECYVFKPKNPDVEKDCPTIIHFVLANINFRKYKAPGVLRETKEEKEIADFDIFDDPESPFSTFNFQYPNQAFKRLHDLMYFNTLNNIDVIKDAIVESIEYRRQNPSRCSVSLSNVEARKFFNKEFLSKPTAESI

SEQ ID NO: 8 - protein, 1463 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 9 - protein, 132 aa, Equus caballus
ENGISPRAVWQFRSMIQCTIPNSKPYLEFNDYGCYCGLGGSGTPVDELDACCQVHDNCYTQAKELSSCRFLVDNPYTESYKFSCSGTEVTCSDKNNACEAFICNCDRNAAICFSKAPYNPENKNLDSKRKCA

SEQ ID NO: 10 - protein, 748 aa, Mus musculus
MSFIDPYQHIIVEHQYSHKFTVVVLRATKVTKGTFGDMLDTPDPYVELFISTTPDSRKRTRHFNNDINPVWNETFEFILDPNQENVLEITLMDANYVMDETLGTATFPVSSMKVGEKKEVPFIFNQVTEMILEMSLEVCSCPDLRFSMALCDQEKTFRQQRKENIKENMKKLLGPKKSEGLYSTRDVPVVAILGSGGGFRAMVGFSGVMKALYESGILDCATYIAGLSGSTWYMSTLYSHPDFPEKGPEEINEELMKNVSHNPLLLLTPQKVKRYVESLWKKKSSGQPVTFTDIFGMLIGETLIQNRMSMTLSSLKEKVNAARCPLPLFTCLHVKPDVSELMFADWVEFSPYEIGMAKYGTFMAPDLFGSKFFMGTVVKKYEENPLHFLMGVWGSAFSILFNRVLGVSGSQNKGSTMEEELENITAKHIVSNDSSDSDDEAQGPKGTENEEAEKEYQSDNQASWVHRMLMALVSDSALFNTREGRAGKVHNFMLGLNLNTSYPLSPLRDFSSQDSFDDELDAAVADPDEFERIYEPLDVKSKKIHVVDSGLTFNLPYPLILRPQRGVDLIISFDFSARPSDTSPPFKELLLAEKWAKMNKLPFPKIDPYVFDREGLKECYVFKPKNPDVEKDCPTIIHFVLANINFRKYKAPGVLRETKEEKEIADFDIFDDPESPFSTFNFQYPNQAFKRLHDLMYFNTLNNIDVIKDAIVESIEYRRQNPSRCSVSLSNVEARKFFNKEFLSKPTV

SEQ ID NO: 11 - protein, 1463 aa, Bos taurus
MPLLSLSLLLLLLQVPAGSAETAAWAVTPERLREWQDKGIFIIQSENLEKCIQASKSTLTLENCKPPNKYMLWKWVSNHRLFNIGGSGCLGLNVSSPEQPLSIYECDSTHVSLKWHCNKKTITGPLQYLVQVKQDNTLVASRKYLHKWVSYMSGGGGICDYLHKDLYTIKGNAHGTPCMFPFQYNQQWHHECTREGREDNLLWCATTSRYERDEKWGFCPDPTSTEVGCDAVWEKDLHSRICYQFNLLSSLSWSEAHSSCQMQGAALLSIADETEENFVRKHLGSEAVEVWMGLNQLDEDAGWQWSDRTPLNYLNWKPEINFEPFVEYHCGTFNAFMPKAWKSRDCESTLPYVCKKYLNPTDHGVVEKDAWKYYATHCEPGWNPHNRNCYKLQKEKKTWNEALQSCQSNNSVLTDITSLAEVEFLVTLLGDENASETWIGLSSHKIPVSFEWSNGSSVTFTNWHTLEPHIFPNRSQLCVSAEQSEGHWKVKNCEETLFYLCKKTGLVLSDTESGCQKGWERHGKFCYKIDTVLRSFDHASSGYYCPPALITITSRFEQAFITSLISSVVKTKDTYFWIALQDQNNTGEYTWKTAGQQLEPVKYTHWNTRQPRYSGGCVVMRGRSHPGRWEVRDCRHFKAMSLCKQPVENREKTKQEEGWPFHPCYLDWESEPGLASCFKVFHSEKVLMKRTWRQAEEFCEEFGAHLASFAHIEEENFVNELLHSKFNRTEERQFWIGFNKRNPLNAGSWEWSDGTPVVSSFLDNSYFGEDARNCAVYKANKTLLPSYCGSKREWICKIPRDVRPKVPPWYQYDAPWLFYQDAEYLFHISASEWSSFEFVCGWLRSDILTIHSAHEQEFIHSKIRALSKYGVNWWIGLREERASDEFRWRDGSPVIYQNWDKGKERSMGLNESQRCGFISSITGLWASEECSISMPSICKRKKVWVIEKKKDIPKQHGTCPKGWLYFDYKCLLLKIPEGPSDWKNWTSAQDFCVEEGGTLVAIENEVEQAFITMNLFGHTTNVWIGLQDDDYEKWLNGRPVSYSNWSPFDTKNIPNHNTTEVQKRIPLCGLLSNNPNFHFTGKWYFEDCREGYGFVCEKMQDASGHSINTSDMYPIPNTLEYGNRTYKIINANMTWYTALKTCLMHGAELASITDQYHQSFLTVILNRVGYAHWIGLFTEDNGLSFDWSDGTKSSFTFWKDDESSFLGDCVFADTSGRWSSTACESYLQGAICQVPTETRLSGRLELCSETSIPWIKFKSNCYSFSTVLESTSFEAAHEFCKKKGSNLLTIKDEAENSFLLEELLAFRSSVQMIWLNAQFDGDNETIKWFDGTPTDQSNWGIRKPEVYHFKPHLCVALRIPEGVWQLSSCQDKKGFICKMEADIHTVKKHPGKGPSHSVIPLTVALTLLVILAISTLSFCMYKHSHIIFGRLAQFRNPYYPSANFSTVHLEENILISDLEKNDQ

SEQ ID NO: 12 - protein, 749 aa, Equus caballus
MSFIDPYQHIIVEHQYSHKFTVVVLRATKVTKGAFGDMLDTPDPYVELFISSTPDSRKRTRHFNNNINPVWNETFEFILDPNQENVLEITLMDANYVMDETLGTATFTLSSMKVGEKKEVPFIFNQVTEMILEMSLEVCSCPDLRFSMALCDQEKTFRQQRKENIKENMKKLLGPKKSEGLYSTRDVPVVAILGSGGGFRAMVGFSGVMKALYESGILDCATYLAGLSGSSWYMSTLYSHPDFPEKGPEEINKELMKNVSYDPLLLLTPQKIKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQNKGSTMEEELENITAKHIVSNDSSDSDDESQEPKGTENEDAERDYQNDNQASWVHRMLMALVSDSALFNTREGRAGKVHNFMLGLNLNTSYPLSPLRNFTTQESLDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDVEKDCPTIIHFVLANINFRKYKAPGVPRETKEEKEIADFDIFDDPESPFSTFNFQYPNQAFKRLHDLMHFNTLNNIDVIKNAMVESIEYRRQNPSRCSVSLSNVEARRFFNKEFLNKPTA

SEQ ID NO: 13 - protein, 1458 aa, Oryctolagus cuniculus
MLLSLLLLLLLGAPRRCTEGAAAALSPERVLKWQEKGIFIIQSESLKSCIQAGKSVLTLESCKQPNKNMLWKWVSNQHLFNIGGSGCLGLNLSNPEQPLGLYECDSTHVSLRWRCNRKMITGPLQHTVQVKQDNIIVASGKRLHKWISYMSDSGDICQHVHKDLYTRKGNAHGTPCMFPFQYNHQWHHECTREGRQDDSLWCATTSRYERDEKWGFCPDPTSAEVGCDAVWEKDLNSHICYQFNLLSSLSWSEAHSSCQMHGGALLSIVDEAEENFIRKQVSGEAVEVWTGLNQLDVNAGWQWSDGTPLSYLNWSPEISFEPFVEYHCGTFNSFMPRAWRSRNCESTLPYICKKYLNHVDDEIVEKDAWKYYATDCEPGWAPYHRNCYKLQKEEKTWNEALHSCLSSNSTLIDIGSLAEVEFLVTLLGNENASETWIGLSSNTFPVSFEWSNGSSVIFTNWHTLEPQIFPNRSQLCVSAEQSEGHWKVTDCEETHFYVCKKPGHVLSDAESGCQEGWERHGGFCYKIDTVLRSFDHASSGYYCPPALVTIADRFEQAFITSLISSVVNMKDSYFWIALQDQNDTGEYTWKTAGQKSEPVQYTHWNAHQPRSSGGCVAIRGRNPIGRWEVKDCVHFKAMSLCKQPVETREKMEHEERWPFHPCYLDWESQPGLASCFKVFHSEKVLMKRTWREAEAFCEEFGAHLASFAHIEEENFVNELLHPKFNRSEERQFWIGFNKRNPLNAGSWEWSDGTPVISSFLDNNYFGEDTRNCAVYKANKTLLPLHCGSKREWICKIPRDVRPKIPSWYQYDAPWLFHQDAEYLFYPHSSEWSSFEFVCGWLRSDILTIHSAHEQEFILSKIKALSKYGANWWIGLQEETANDELRWRDGTPVIYQNWDKERDRSMNNQSQRCAFISSITGLWDREECSVSMPSICKRKTFWVIEKEKDTPKQHGTCPKGWLYFDYKCLLVNVPKDPSNWKNWTQARDFCFDEGGTLVAIESEVEQAFITMNLFGQTTNVWIGLQNDDYEKWLNGNPVAYSNWSPSDIINIPSYNTTADQKPIPLCALLSSNPNFHFTGKWYFEDCGKEGYGFVCEKIQDSAGHEVNTSIMDPIPNTLEYGNRTYKIINANMTWYAAIKSCQLHGAELVSITDQYHQSFLTVILSRLGHAHWIGLFTADNGLHFDWSDGTKSSFTFWKDEDSSFLGDCVFADTSGRWHSTACESFLQGAICHVPTETRPFEHPELCSETSIPWIKFKSNCYSFSTVLHSASFEAAHEFCKKEGSNLLTIKDEAENSFLLEEPFAFGASVQMVWLNAQFDNETVKWLDGTPADQSNWGIRKPDMAHFEPHQCLALRIPEGVWQLSPCQKNMGFICKMKADIHTVKEHPGKGPSHSIVPLAVALTLVVILAIITLSFYIYKQNKGFFRRLAGVGNSYYPTTNFSTIHLEENILISDLEKND

SEQ ID NO: 14 - protein, 1464 aa, Pongo abelii
MLLSPSLLLPLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCDRKMITGPLQYSVQVAHDNTVVASRKYFHKWISYGSGGGDICEYLHKDLHTIKGNAHGMPCMFPFQYNHQWHHECTREGREDDLLWCATTSRYERDEKWGFCPDPTSAEVGCDTIWEKDLNSHICYQFNLLSSLSWSEAHSSCQMQGGALLSITDETEENFIREHMSSKTVEVWMGLNQLDEHAGWQWSDGTPLNYLNWSPEVNFEPFVEDHCGTFSSFIPSAWRSRDCASTLPYVCKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPQIFPNRSQLCVSAEQSEGHWKVKNCEETLFYVCKKAGHVLSDAESGCQEGWERHGGFCYKIDTVLRSFDQASSGYYCPPALVTITNRFEQAFITSLIGSVVKMKDSYFWIALQDQNDTGEYTWKPAGQKPEPVQYTHWNAHQPRYSGGCVAMRGRHPPGRWEVKHCRHFKAMSLCKQPVENQEKAEYEERWPFHPCYLDWESEPGLASCFKVFHSEKVLMKRTWREAEAFCEEFGAHLASFAHIEEENFVNELLYSKFNWTEERQFWIGFNKRNPLNAGSWEWSDRIPVVSSFLDNNYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERPVNNQSQRCGFISSITGLWGSEECSVSMPSICKRKKVLLIEKKKDTPKQHGTCPKGWLYFNYKCLLLNIPKDPNSWKNWMHAQHFCAEEGGTLVAIESEVEQAFITMNLFGQTTNVWIGLQNDDYETWLNGKPVVYSNWSPFDIINIPSHNTTDVQKHIPLCALLSSNPNFHFTGKWYFEDCGKEGYGFVCEKMQDTSGHGVNTSDMYPMPNTLEYGNRTYKIINANMTWYAAIKTCLMHGTQLVSITDQYHQSFLTVVLNRLGYAHWIGLFTTDNGLNFDWSDGTKSSFTFWKDEESSLLGDCVFADTNGLWHSTACESFLQGAICHVPPETRQSEHPELCSETSIPWIKFKSNCYSFSTVLDRMSFEAAHEFCKKEGSNLLTIKDEAENAFLLEELFAFGSSVQMVWLNAQFDGNNETIKWFDGTPTDQSNWGIRKPDTDYFKPHHCVALRIPEGLQLSLCQEKKGFICKMEADIRTAEELPEKGPSHSIIPLAVVLTLIVIVAICTLSFCIYKHNGGFFRRLAGFRNPYYPATNFSTVHLEENILISDLEKSDQ

SEQ ID NO: 15 - protein, 146 aa, Sus scrofa
MKFLVLAVLLTVGAAQEGISSRALWQFRSMIKCAIPGSHPLMDFNNYGCYCGLGGSGTPVDELDRCCETHDNCYRDAKNLDSCKFLVDNPYTESYSYSCSNTEITCNSKNNACEAFICNCDRNAAICFSKAPYNKEHKNLDTKKYC

SEQ ID NO: 16 - protein, 145 aa, Bos taurus
MRLLVLAALLTVGAGQAGLNSRALWQFNGMIKCKIPSSEPLLDFNNYGCYCGLGGSGTPVDDLDRCCQTHDNCYKQAKKLDSCKVLVDNPYTNNYSYSCSNNEITCSSENNACEAFICNCDRNAAICFSKVPYNKEHKNLDKKNC

SEQ ID NO: 17 - protein, 146 aa, Rattus norvegicus
MKVLLLLAVVIMAFGSIQVQGSLLEFGQMILFKTGKRADVSYGFYGCHCGVGGRGSPKDATDWCCVTHDCCYNRLEKRGCGTKFLTYKFSYRGGQISCSTNQDSCRKQLCQCDKAAAECFARNKKSYSLKYQFYPNKFCKGKTPSC

SEQ ID NO: 18 - protein, 1012 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 19 - protein, 119 aa, Sus scrofa
ALWQFRSMIKCAIPGSHPLMDFNNYGCYCGLGGSGTPVDELDRCCETHDNCYRDAKNLSGCYPYTESYSYSCSNTEITCNSKNNACEAFICNCDRNAAICFSKAPYNKEHKNLDTKKYC

SEQ ID NO: 20 - protein, 119 aa, Sus scrofa; identical to SEQ ID NO: 19

SEQ ID NO: 21 - protein, 541 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFPALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 22 - protein, 806 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 23 - protein, 124 aa, Homo sapiens [sequence omitted]

SEQ ID NO: 24 - protein, 124 aa, Homo sapiens [sequence omitted]

SEQ ID NO: 25 - protein, 146 aa, Mus musculus
MKVLLLLAASIMAFGSIQVQGNIAQFGEMIRLKTGKRAELSYAFYGCHCGLGGKGSPKDATDRCCVTHDCCYKSLEKSGCGTKLLKYKYSHQGGQITCSANQNSCQKRLCQCDKAAAECFARNKKTYSLKYQFYPNMFCKGKKPKC

SEQ ID NO: 26 - protein, 501 aa, Bos taurus
MGVLVVLLGVLSFLGRTLGGSPALHWDSTSCHLARPIPGRPLRSLSFLGKDAQGLALFHAHWDGHGRLQVCSRQDEPELTAAYGALCAGEITRGSFIHTPGPELQRALATLQSQWEACRGPAESPAGTREKRAAGQNGVPGIGRQWVKRGWTVPGTLWCGVGDSAGNSSELGVFQGPDLCCREHDRCPHNVSPFQYNYGIRNYRFHTISHCNCDARFQQCLQDQRDSVSDIMGVAFFNVLAIPCFVLEEQEACVEWYWWGGCRRYGSVPFARLQPRTFYNASWSSPATSLTPSPQNPALSRPQPMQHPQQWPSEWKESKSPSKTNATALQAPVASPGSDRASTVQLEVTHPGFQGTTGGRKPPGAHRACRSFRHLDQCEHQIGPQETKFQLFNSAHEPLFHCNCTRRLARFLRLHGPPVGASMLWELPGMTCFKLAPPLDCAEGKGCPRDPRAFKVSARHLLRLQQRRLQLQGTGTDNGQVWPSEDQGAPISFYNRCLQLT

SEQ ID NO: 27 - protein, 509 aa, Homo sapiens
MGVQAGLFGMLGFLGVALGGSPALRWYRTSCHLTKAVPGNPLGYLSFLAKDAQGLALIHARWDAHRRLQACSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 28 - protein, 68 aa, Oryctolagus cuniculus
  misc_feature (38)..(38): Xaa can be any naturally occurring amino acid
  misc_feature (67)..(67): Xaa can be any naturally occurring amino acid
HLLDFRKMIRYTTGKEATTSYGAYGCHCGVGGRGAPKXAKFLSYKFSMKKAAAACFKYQFYPNNRCXG

SEQ ID NO: 29 - protein, 151 aa, Mus musculus
MLLLLLLLLLGPGPGFSEATRRSHVYKRGLLELAGTLDCVGPRSPMAYMNYGCYCGLGGHGEPRDAIDWCCYHHDCCYSRAQDAGCSPKLDRYPWKCMDHHILCGPAENKCQELLCRCDEELAYCLAGTEYHLKYLFFPSILCEKDSPKCN

SEQ ID NO: 30 - protein, 138 aa, Homo sapiens
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 31 - protein, 146 aa, Canis lupus
MKFLVLAALLTVAAAEGGISPRAVWQFRNMIKCTIPESDPLKDYNDYGCYCGLGGSGTPVDELDKCCQTHDHCYSEAKKLDSCKFLLDNPYTKIYSYSCSGSEITCSSKNKDCQAFICNCDRSAAICFSKAPYNKEHKNLDTKKYC

SEQ ID NO: 32 - protein, 146 aa, Rattus norvegicus
MKLLLLAALLTAGVTAHSISTRAVWQFRNMIKCTIPGSDPLREYNNYGCYCGLGGSGTPVDDLDRCCQTHDHCYNQAKKLESCKFLIDNPYTNTYSYKCSGNVITCSDKNNDCESFICNCDRQAAICFSKVPYNKEYKDLDTKKHC

SEQ ID NO: 33 - protein, 148 aa, Homo sapiens
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 34 - protein, 818 aa, Homo sapiens
MESLSPGGPTGHPYQGEASTCWQLTVRVLEARNLRWADLLSEADPYVILQLSTAPGMKFKTKTLTDTSHPVWNEAFRFLIQSQVKNVLELSIYDEDSVTEDDICFKVLYDISEVLPGKLLRKTFSQSPQGEEELDVEFLMEETSDRPENLITNKVIVARELSCLDVHLDSTGSTAVVADQDKLELELVLKGSYEDTQTSFLGTASAFRFHYMAALETELSGRLRSSRSNGWNGDNSAGYLTVPLRPLTIGKEVTMDVPAPNAPGVRLQLKAEGCPEELAVHLGFNLCAEEQAFLSRRKQVVAKALKQALQLDRDLQEDEVPVVGIMATGGGARAMTSLYGHLLALQKLGLLDCVTYFSGISGSTWTMAHLYGDPEWSQRDLEGPIRYAREHLAKSKLEVFSPERLASYRRELELRAEQGHPTTFVDLWALVLESMLHGQVMDQKLSGQRAALERGQNPLPLYLSLNVKENNLETLDFKEWVEFSPYEVGFLKYGAFVPPELFGSEFFMGRLMRRIPEPRICFLEAIWSNIFSLNLLDAWYDLTSSGESWKQHIKDKTRSLEKEPLTTSGTSSRLEASWLQPGTALAQAFKGFLTGRPLHQRSPNFLQGLQLHQDYCSHKDFSTWADYQLDSMPSQLTPKEPRLCLVDAAYFINTSSPSMFRPGRRLDLILSFDYSLSAPFEALQQTELYCRARGLPFPRVEPSPQDQHQPRECHLFSDPACPEAPILLHFPLVNASFKDHSAPGVQRSPAELQGGQVDLTGATCPYTLSNMTYKEEDFERLLRLSDYNVQTSQGAILQALRTALKHRTLEARPPRAQT

SEQ ID NO: 35 - protein, 855 aa, Mus musculus
MPWTLQPKWLAGKGLPLLGAILLRKTEKSEPQWKHRRQETHPYYDLQVKVLRARNIQHTDKLSKADCYVRLWLPTASVSPSQTRTVVNSSDPEWNETFHYQIHGAVKNVLELALYDEDVLDSDNVFSILFDMSTLQLGQPCTKNFTRQQDPKELEVEFTLEKSQTPASEVVTNGVLVAHPCLRIQGTVTGDKTASLGELGSRQIQLAVPGAYEKPQPLQPTSEPGLPVNFTFHMNPVLSPKLHIKLQEQLQVFHSGPSDELEAQTSKMDKASILLSSLPLNEELTKLVDLEEGQQVTLRMKADMSSSGDLDLRLGFDLCDGEQEFLDKRKQVASKALQRVMGLSEALHCDQVPVVAVLGSGGGTRAMTSLYGSLAGLQELGLLDAVTYLSGVSGSSWCISTLYRDPSWSQKALQGPIKYASERVCSSKIGMLSPKQFEYYSREKRAWESRGHSMSFTDLWGLIIEYFLNQEENPAKLSDQQETVSQGQNPYPIYASINVHKNISGDYFAEWCEFTPYEVGFPKYGVYVPTELFGSEFFMGRLLHFWPEPRICYLQGMWGSAFAASLYEIFLKLGGLSLSFLDWHRGSVSVTDDWPKLRKQDPTRLPTRLFTPMSSFSQAVLDIFTSRITCAQTFNFTRGLCMYKDYTARKDFVVSEDAWHSHNYGYPDACPNQLTPMKDFLSLVDGGFAINSPFPLVLQPQRAVDLIVSFDYSLEGPFEVLQVTEKYCRDRGIPFPRIEVDPKDSEDPRECYLFTEAEDPCSPIVLHFPLVNRTFRTHLAPGVERQTAEEKAFGDFIINGPDTAYGMMDFTYEPKEFDRLVTLSRYNVLNNKETIRHALQLALDRRRQAGGRVGG

SEQ ID NO: 36 - protein, 825 aa, Mus musculus
MWSGDRRVGMESLSPERLHGHPYQEEASVFCRLTVKILEARSLPRADLLSQADPYVTVQLPTASGMKFKTQTVTNSSHPVWNETFSFLIQSQVKNILELTIYDEDVITKDDICFKVSYDVSEILPGQLLQKTFSLNPQGPEELDVELLMERTWDPPENLITNNVLVARELSHLDVSLDRAGNTAMAAGQDKLELELMLKGSYEDTQTFFPDTAFTFSFHYMGGQDTELNGYLRGPRNSGWNSDTSVTPFNVPLMSLAAGKEMTIDIPAMKAPEGKLQLKTDCCPKELSVRLSYGLCPEEQAFLSRRKKVVAAALKQALQLDEDLNEDEVPVVGINAEGGGMRAMISLYGHLLALQKLGLLDCVTYFSGISGSTWTMAHLYRDPEWSQRDLEGPISHAREHVAKTLLKEFLPEHLASYRQTLKLREEQGYTVTVADLWGLVLESKLHGQVTDQKLSGQRAALERGQNPLPLYLSLNVKENHLGTLHFKEWVEFSPYEVGFLKYGGFVPSELFGSEFFMGRLMKRLPESQICFLEGIWSNLFSVNLMDIWYDITYGKDSNNFPVDVRNSEKEFSGSAGTSSGVEAPWLESGTALAQALKGFLTGRPFHQRSANFLHGLQLHRDYCNQRHFSTWADCNLDDTPNQLTPQDPQLCLIDAGCFMNSSCPSLFRPGRQVDLIISFNYNQSLPFKGLQQSEKYSRARGLPFPRVEPSPEDHSQPQECYLFSDPTCPEAPVVLHFPLVNDSFRDHSAPGVRRSPDELKAGQVNLTGAASPYFMYNMTYKNEDFDRLLQLSDYNVQNNQGTILQALRTVLKRRASETRPLGVKT

SEQ ID NO: 37 - protein, 155 aa, Homo sapiens
MLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 38 - protein, 144 aa, Oryctolagus cuniculus
MKFLVLAALLTAGTAASGVSPTALWQFRGMIQCTIPGSSPYLEFNGYGCYCGLGGSGTPVDELDRCCQTHDQCYTQAKKLSSCSFLVDNPYTNSYSYSCSGTTVTCSSKNKECEAFICDCDRKAAICFSKRPYNKEYKPISKYC

SEQ ID NO: 39 - protein, 137 aa, Mus musculus
MKGLLTLAWFLACSVPAVPGGLLELKSMIEKVTGKNAFKNYGFYGCYCGWGGRGTPKDGTDWCCQMHDRCYGQLEEKDCAIRTQSYDYRYTNGLVICEHDSFCPMRLCACDRKLVYCLRRNLWTYNPLYQYYPNFLC

SEQ ID NO: 40 - protein, 137 aa, Rattus norvegicus
MKRLLTLAWFLACSVPAVPGGLLELKSMIEKVTGKNAVKNYGFYGCYCGWGGHGTPKDGTDWCCRMHDRCYGLLEEKHCAIRTQSYDYRFTQDLVICEHDSFCPVRLCACDRKLVYCLRRNLWSYNRLYQYYPNFLC

SEQ ID NO: 41 - protein, 145 aa, Cavia porcellus
MKLLLLLLVVMASDLPQAHGHLKQFTEMIKLTTGKNGLTSYGAYGCHCGVGGKGTPKDATDRCCVRHDCCYDRLMKRGCGTKFLNYRFTHKGSSITCSVKQNSCQKQLCECDKAAAYCFAANLKSYSRRYQFYYNGLCRGKTPSC

SEQ ID NO: 42 - protein, 150 aa, Mus musculus
MKGIAIFLVFIFYWTTSTLSSFWQFQRMVKHVTGRSAFFSYYGYGCYCGLGGKGLPVDATDRCCWAHDCCYHKLKEYGCQPILNAYQFTIVNGTVTCGCTVASSCPCGQKACECDKQSVYCFKENLATYEKAFKQLFPTRPQCGRDKLQC

SEQ ID NO: 43 - protein, 146 aa, Cavia porcellus
MKLLVLAALLSVSAAAHIITPRALWQFRDMIKCAIPGSRPYSEYNNYGCFCGLGGSGTPVDELDRCCEIHDACYTQAKHLESCKSVIDNPYTNSYSFSCSGTNIICSSKNKECEEFICNCDRAAAICFSKAPYNENNKNINKKERC

SEQ ID NO: 44 - protein, 752 aa, Mus musculus
MQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGPGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKQLQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 45 - protein, 849 aa, Homo sapiens
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDVEEARECYLFAKAEDPRSPIVLHFPLVNRTFRTHLAPGVERQTAEEKAFGDFVINRPDTPYGMMNFTYEPQDFYRLVALSRYNVLNNVETLKCALQLALDRHQARERAGA

SEQ ID NO: 46 - protein, 1012 aa, Mus musculus
MAEAALEAVRRALQEFPAAARDLNVPRVVPYLDEPPSPLCFYRDWVCPNRPCIIRNALQHWPALQKWSLSYLRATVGSTEVSVAVTPDGYADAVRGDRFVMPAERRLPISHVLDVLEGRAQHPGVLYVQKQCSNLPTELPQLLSDIESHVPWASESLGKMPDAVNFWLGDASAVTSLHKDHYENLYCVVSGEKHFLLHPPSDRPFIPYNLYTPATYQLTEEGTFRVVDEEAMEKVPETCLLTVRVLRASGLPSKDLVTSSDCYVTLNLPTASSHTLQTRTVKNSRNPVWNQNFHFRIHRQLKNVIELKAFDHDLVTRDDPVLSVLFDVGTLQIGTQRQSFSLGTQEKGCLEVEFRLQTLTDCEEQLISNGIVVARELSCLHVELKRTGDPKRSERKVQLVVAGACEGPQDASAGTGSFHFHYPACWEQELNVHLQDDPHEQLKVPLRTLPSSQLVRLVFPTSQEPLMRLELKKEEGPKELAVRLGCGPCPEEQAFLSKRKQVVAAALKKALQLDQDLHEDEIPVIAVMATGGGIRAMTSLYGQLAGLQELGLLDCISYITGASGSTWALANLYEDPEWSQKDLAGPTEVLKTQVTKSKLGALAPSQLWRYRQELAERARLGHPTCFTNLWALINEALLHDKPHEHKLSDQREALSRGQNPLPIYCALNSKEQGLSTFDFGEWCEFSPYEVGFPKYGAFISSELFGSEFFMGRLVKQLPESRICFLEGIWSNLFAASLQDSLYWSSEPSQFWDRWAQDQANLDKEQVPHLKIAEPPTMAGRIAELFTDLLTKRPLAHATHNFTRGLHFHKDYFQNSHFSAWKASKLDRLPNQLTPTEPHLCLLDVGYLINTSCPPLLQPTRDVDLILSLDYNLYGAFQQLQLLSRFCQEQGIPFPSISPSPEEQRQPQECHLFCDPAQPEAPAVLHFPLVNDSFQDYSAPGVPRTSEEKAAGEVNLSSSDSPYHYTKVTYSQEDVDKLLRLTHYNICNNQDRLREAMHQAVQRRRKRKQFRPE

SEQ ID NO: 47 - protein, 751 aa, Rattus norvegicus
MQFFGRLVNTLSSVTNLFSNPFRAKEVSLADYASSERVREEGQLILLQNASNRTWDCDLVSPRNPQSDFRLFQLESEADVLVNFQQYSSQLPPFYESSEQVLHVEVLQLTDLIRNHPSWTVTHLAVELGIRECFHHSRIITCANSTENEEGCTPLHLACRKGDSEILVELVQYCHAQMDVTDNKGETAFHYAVQGDNPQVLQLLGKNASAGLNQVNNQGLTPLHLACQMGKQEMVRVLLLCNARCNIMGPGGFPIHTAMKFSQKGCAEMIISMDSNQIHSKDPRYGASPLHWAKNAEMARMLLKRGCDVDSTSASGNTALHVAVTRNRFDCVMVLLTYGANAGARGEHGNTPLHLAMSKDNMEMVKALIVFGAEVDTPNDFGETPAFIASKISKQLQDLMPVSRARKPAFILSSMRDEKRTHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCTPNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEYREEFQKLVQLLLSP

SEQ ID NO: 48 - protein, 144 aa, Bos taurus
MKTLLLLAVIMAIGLLQVHGDLLNFRKMIKLTTGKEPATRYSFYGCYCGMSGRGTPKDATDWCCRAHDCCYKNLESRGCRTKFLKYNVTYQEDQIVCEDADDCKSQVCQCDKIAANCFAANLKTYNKKLRFYNKFRCRGAAPAC

SEQ ID NO: 49 - protein, 151 aa, Rattus norvegicus
MLLLLLLLLLGPGSCLSEATRRSHVYKRGLLELAGTLDCVGPRSPMAYMNYGCYCGLGGHGEPRDAIDWCCYYHDCCYSQAQDAGCSPKLYRYPWKCMDHRILCGPAENKCQELLCRCDETLAYCLADTEYHLKYLFFPSVLCEKDSPKCN

SEQ ID NO: 50 - protein, 146 aa, Mus musculus
MKLLLLAALLTAGAAAHSISPRAVWQFRNMIKCTIPGSDPLKDYNNYGCYCGLGGWGTPVDDLDRCCQTHDHCYSQAKKLESCKFLIDNPYTNTYSYSCSGSEITCSAKNNKCEDFICNCDREAAICFSKVPYNKEYKNLDTGKFC

SEQ ID NO: 51 - protein, 150 aa, Rattus norvegicus
MKGIAVFLVFIFCWTTSTLSSFWQFQRMVKHITGRSAFFSYYGYGCYCGLGGRGIPVDATDRCCWAHDCCYHKLKEYGCQPILNAYQFAIVNGTVTCGCTMGGGCLCGQKACECDKLSVYCFKENLATYEKTFKQLFPTRPQCGRDKLHC

SEQ ID NO: 52 - protein, 838 aa, Homo sapiens
MLLRQMHARVSHSLPDPCQAEDSRPSATCALKAPQTSWDGLLREGLSPCHLLTVRVIRMKNVRQADMLSQTDCFVSLWLPTASQKKLRTRTISNCPNPEWNESFNFQIQSRVKNVLELSVCDEDTVTPDDHLLTVLYDLTKLCFRKKTHVKFPLNPQGMEELEVEFLLEESPSPPETLVTNGVLVSRGHGWLLLSGEQDQGRKQWAKDLLVMVNESFENTQRVRPCLEPCCPTSACFHYPKYFQSQVHVEVPKSHWSCGLCCRSRKKGPISQPLDCLSDGQVMTLPVGGGESLGSPETLDVRLGFSLCPAELEFLQKRKVVVAKALKQVLQLEEDLQEDEVPLIAIMATGGGTRSMTSMYGHLLGLQKLNLLDCASYITGLSGATWTMATLYRDPDWSSKNLEPAIFEARRHVVKDKLPSLFPDQLRKFQEELRQRSQEGYRVTFTDFWGLLIETCLGDERNECKLSDQRAALSCGQNPLPIYLTINVKDDVSNQDFREWFEFSPYEVGLQKYGAFIPSELFGSEFFMGRLVKRIPESRICYMLGLWSSIFSLNLLDAWNLSHTSEEFFHRWTREKVQDIEDEPILPEIPKCDANILETTVVIPGSWLSNSFREILTHRSFVSEFHNFLSGLQLHTNYLQNGQFSRWKDTVLDGFPNQLTESANHLCLLDTAFFVNSSYPPLLRPERKADLIIHLNYCAGSQTKPLKQTCEYCTVQNIPFPKYELPDENENLKECYLMENPQEPDAPIVTFFPLINDTFRKYKAPGVERSPEELEQGQVDIYGPKTPYATKELTYTEATFDKLVKLSEYNILNNKDTLLQALRLAVEKKKRLKGQCPS

SEQ ID NO: 53 - protein, 875 aa, Mus musculus
MQSIPHSDEADVAGMTHASEGHHGLGTSMLVPKNPQGEEDSKLGRNCSGFEDAQDPQTAVPSSPLLSMASCSSQEGSSPCHLLTVRIIGMKNVRQADILSQTDCFVTLWLPTASQKKLKTRTISNCLHPEWDESFTFQIQTQVKNVLELSVCDEDTLTQNDHLLTVLYDLSKLCLRNKTHVKFPLNPEGMEELEVEFLLEENFSSSETLITNGVLVSRQVSCLEVHAESRRPRKRKKNKDLLVMVTDSFENTQRVPPCQEPCYPNSACFHYPKYSQPQLYAEAPKSHCNFRLCCCGTHRNDPVCQPLNCLSDGQVTTLPVGENYELHMKSSPCSDTLDVRLGFSLCQEEVEFVQKRKMVVAKTLSQMLQLEEGLHEDEVPIIAIMATGGGTRSMVSLYGHLLGLQKLNFLDASTYITGLSGATWTMATLYSDPEWSSKNLETVVFEARRHVVKDKMPALFPDQLYKWREDLQKHSQEGYKTTFTDFWGKLIEYSLGDKKNECKLSDQRAALCRGQNPLPIYLTINVKDDVSNQDFREWFEFSPYEVGMQKYGAFIPSELFGSEFFMGRLMKRIPEPEMCYMLGLWSSIFSLNLLDAWNLSHTSEEFFYRWTRERLHDIEDDPILPEIPRCDDNPLETTVVIPTTWLSNTFREILTRRPFVSEFHNFLYGMQLHTDYLQNRQFSMWKDTVLDTFPNQLTQFAKHLNLLDTAFFVNSSYAPLLRPERKVDLIIHLNYCAGSQTKPLKQTCEYCTEQKIPFPSFSILEDDNSLKECYVMENPQEPDAPIVAYFPLISDTFQKYKAPGVERSPDELELGQLNIYGPKSPYATKELTYTEAAFDKLVKLSEYNILNNRDKLIQALRLAMEKKRMRSQCPS

SEQ ID NO: 54 - protein, 786 aa, Oryctolagus cuniculus
MSINLTIDICIYLLSNARNLCGKHRSKQLHLVCSPNHCWKIRHVSLQRGLHPHKVRCKWTKSETHSCSKHYYSPSNHGLHIGILKLSTSAPKGLTKVSIRMSRIKSTLNSVSKAVFGSQNEMISRLAQFKPSSRILRKVSDSGWLKQESIKQAIRSLKKYSDKSTEKSPVPEGRNHIIDKEDDIGKQSLFHYTGNITTKFGESFYFLSNHINSYFKRAEKMSQDKENSHFQEKSELEGKKVEEGKSSSLDPGILTSQADKPDPKSSAGTMDKATSPSGTPESLPISTKQSIANFLSRPTEGVQALVGGYIGGLVPKLKYDSKSQAEEQEEPAKSEPAGSKDKTVEEKKHLSLQREKIIARVSIDNRTRALVQALRRTADPKLCITRVEELTFHLLEFPEGKGVAVKERLIPCLLRLRQMKDETLQAAVREILALIGYVDPVKGRGIRILTIDGGGTRGVVALQTLRKLVELTQKPVHQLFDYICGVSTGAILAFMLGLFHLPLDECEELYRKLGSDIFSQNVIVGTVKMSWSHAFYDSQTWEKILKERMGSALMIETARNPMCPKVAAVSTIVNRGSTPKAFVFRNYGHFPGSQSHYLGGCQYKMWQAIRASSAAPGYFAEYALGNDLHQDGGLLLNNPSALAMHECKCLWPDAPLECIVSLGTGRYESDVRNNTTYTSLKTKLSNVINSATDTEEVHIMLDGLLPPDTYFRFNPVMCENIPLDESRNEKLDQLQLEGSKYIERNEHKMKKVAKILSQEKTTLQKINDWIKLKTDMYEGLPFFSKL

SEQ ID NO: 55 - protein, 782 aa, Canis familiaris
MGDHARLTRDSIFFQTEGAGGGASSPAPQKMQFFGRLVNTLSSVTNLFSNPFRVKEVAVADYTSSARVRDEGQLILFQNIPNRTWDCILVNPRNSQSGFRLFQLETEADALVNFQQYSSQLPPFYESSKHVLHTEVLQQLTDLIRSHPSWSAAHLAVELGIRECFHHSRIISCANNRENEEGCTPLHLACRKGDGEILVELVQYCHAQMDVTDNNGETAFHYAVQGDNSQVLQLLGKNASAGLNRVNNQGQTPLHLACQMGKQEMVRVLLLCNARCNIMGPTGYPIHTAMKFCHKGCAEMIISMDSNQIHSKDPRYGASPLHWAKNAEMARMLLKRGCDVNSTSCVGNTALHVAVMRNRFDCVMVLLTYGANADARGEHGNTPLHLAMSKDNVEMIKALIVFGAEVDTPNDFGETPASIASKISKQLQDIVQISRSRKPAFILSSMRDEKRTHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYEAPESVREPRFSQNINLKPPTQPSDQLVWRAARSSGAAPTYFRPNGRFLDGGLLANNPTLDAMTEIHEYNQDLIRKGQGNKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREQFQKLIQLLLSP

SEQ ID NO: 56 - protein, 1450 aa, Rattus norvegicus
MESWPGVSLVGLLLLLLLGQGPSQIHGSSGENTSQPQQVFRTLKNFSFPCKPKKLELSVLSKSVHSLRPSDIKLVAAIGNLETPPAPGSGVVNMEKPQSLESELQNVCIGIMTALSDIIRHFNPSVLMPTCSPGKGTAGHTTIAEDLWIQAKELVRHLKDNPELDFEKDWKLITVLFSNTSQCHLCSSDQQKRHLMKHMEMLSGVLDYLHREVPRAFVNLVDLSEVLTMAQQHQETGFSPAPEICKCSEEITKLSKAVMQWSYQEAWEDLLASSKFNKHETFAVVFQSFFSEVELPLERPSPQDSTTLALRIWNSMMEPVGRKDGTLNEAERKTMKCPSQESPYLFTYRNSNYQARQLKPIGKFQMKEGTKFTCPDKDPSDSIPTTVHRLRPADIKVIGAMGDSLTAGNGAGSSPGNVLDVLTQYRGLSWSVGGDETIETVTTLANILREFNPSLKGFSVGTGKENTPRASFNQAVAGAKSDGLAAQAKKLVSLMKDDKTINFQEDWKIITVFIGGNDLCGSCNNLARFSPQTFTDNIKTALDILHAEVPRAFVNMVSVIEITPLRELFNEPKVSCPRMILRSLCPCVLNLGENSAELAQLVERNRQYQEETGKLIESGRYDTRDDFTVVLQPMFENVVMPRTLEGLPDSSFFAPDCFHFNVKTHARSAIALWKNMLEPVGRKTRHQNFEIKVPIMCPNQTSPFLSTTKNSNLGHGTSMSCEEKAPSASPPTSVHTLRPADIQVVAALGDSVTAGNGISSQEGDLADVTTQYRGLSYSAGGDKFLENVTTLPNILREFNGNLTGYSVGTGDVNSASAFLNQAVPGAKAENLASQVQTLIQKMKNDTRVNFHQDWKVITVMIGASDLCDFCKDSNRYSAANFSDHLRNALDILHKEVPRALVNLVDFMNPSIIRQVFLKNPDKCPVNQTSVLCNCVLTPGEDSHELARLEAFTKSYQSSMLQLVESGRYDTREDFSVVLQPFLFNIRLPILENGNPDTSFFAPDCILLSQKFHTQLARALWANMLEPLGKKMDTLDPKELIALACPTKDKPFLRTFRNSNYTYPIKPAIENWGSDFLCTEQSPSSKVPTSVHELRPSDIKVVAAMGDFLTTATGARPSESSSLDTPWRGLSWSIGGDGTLETHTTLPNILKKFNPSILGFSTGTLENTAGLNVAEEGARAQDMPAQAQALVKKMKSTPTINIQEDWKLITLLIGNNDLCLYCEDPENYSTREYVKYIQHALDIFYEELPRVFINVVEVMELSGLLHDQGGKCAMPLAVQKNCSCLKRSQNLMAMQELKKVNGNLQSALSELSYWHRYMQREDFAVTVQPFFRNTFVPLDERGGLDLTFFSEDCFHFSVRGHAEMAIALWNNMLEPVGKKTTSNNFTYNRTKLKCPSPENPFLYTVRNSQILLDKAKENSNTLYWAVPVAAVGGLVVGILGMMLWRTVRLVQ

SEQ ID NO: 57 - protein, 146 aa, Sus scrofa; identical to SEQ ID NO: 15

SEQ ID NO: 58 - protein, 144 aa, Homo sapiens; identical to SEQ ID NO: 6

SEQ ID NO: 59 - protein, 752 aa, Rattus norvegicus
MSFIDPYQHIIVEHQYSHKFTVVVLRATKVTKGTFGDMLDTPDPYVELFISTTPDSRKRTRHFNNDINPVWNETFEFILDPNQENVLEITLMDANYVMDETLGTATFPVSSMKVGEKKEVPFIFNQVTEMILEMSLEVCSCPDLRFSMALCDQEKTFRQQRKENIKENMKKLLGPKKSEGLYSTRDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIQNRMSTTLSSLKEKVSAARCPLPLFTCLHVKPDVSELMFADWVEFSPYEIGMAKYGTFMTPDLFGSKFFMGTVVKKYEENPLHFLMGVWGSAFSILFNRVLGVSGSQNKGSTMEEELENITAKHIVSNDSSDSDDEAQGPKGTENEDAEREYQNDNQASWVHRMLMALVSDSALFNTREGRAGKVHNFMLGLNLNTSYPLSPLRDFSPQDSFDDDELDAAVADPDEFERIYEPLDVKSKKIHVVDSGLTFNLPYPLILRPQRGVDLIISFDFSARPSDTSPPFKELLLAEKWAKMNKLPFPKIDPYVFDREGLKECYVFKPKNPDVEKDCPTIIHFVLANINFRKYKAPGVLRETKEEKEIADFDIFDDPESPFSTFNFQYPNQAFKRLHDLMYFNTLNNIDVIKDAIVESIEYRRQNPSRCSVSLSNVEARKFFNKEFLSKPTAESI

SEQ ID NO: 60 - protein, 749 aa, Homo sapiens; identical to SEQ ID NO: 4

SEQ ID NO: 61 - protein, 752 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 62 - protein, 806 aa, Homo sapiens; identical to SEQ ID NO: 22

SEQ ID NO: 63 - protein, 807 aa, Rattus norvegicus
MQFFGRLVNTLSSVTNLFSNPFRVKEVSLADYASSERVREEGQLILLQNASNRTWDCVLVSPRNPQSGFRLFQLESEADALVNFQQYSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACQMGKQEMVRVLLLCNARCNIMGPGGFPIHTAMKFSQKGCAEMIISMDSNQIHSKDPRYGASPLHWAKNAEMARMLLKRGCDVDSTSASGNTALHVAVTRNRFDCVMVLLTYGANAGARGEHGNTPLHLAMSKDNMEMVKALIVFGAEVDTPNDFGETPAFIASKISKLITRKALLTLLKTVGADYHFPFIQGVSTEQSSAAGPHPFFSLDRTQPPTISLNNLELQDLMPVSRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCTPNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 64 - protein, 441 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 65 - protein, 541 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVIHFPLFNIDACGGDIEAWSDTYDTFKLADTYTLDVVVLLLALAKKNVRENKKKILRELMNVAGLYYPKDSARSCCLA

SEQ ID NO: 66 - protein, 119 aa, Sus scrofa
ALFQFRSMIKCAIPGSHPLMDFNNYGCYCGWGGSGTPVDELDRCCETHDNCYRDAKNLSGCYPYTESYSYSCSNTEITCNSKNNACEAFICNCDRNAAICFSKAPYNKEHKNLDTKKYC

SEQ ID NO: 67 - protein, 119 aa, Sus scrofa; identical to SEQ ID NO: 66

SEQ ID NO: 68 - protein, 1463 aa, Cavia porcellus
MGLQPGVLLVGLLLLGQGITQIHTSSGKSTLEGQLWPETKKNFPFSCSPKKLGLNMPSESVHTLTPADIKLIAAIGDMETPPDSGAVNLDTSERTEKEPWRGCMGMMTVLSDIISHFNPSVLLPTCPPWRSAAVRGGVEELRTQAEELVSSLKKNPQLDFQQDWKLINVFFSNASLCYLCPSAHENGPLMSNMDKLAGILHYLHQEVPRAFVNLVDLFEVVAMPRWHQGTMLSRPSPEACGCSGETSKLDTVVMQWSYQETWDSLLASSSFNDQESFAVVFQPFFYEVSSPVEEPPSQDPTTLALSLWNNMMKPVGQKDEPFSTIERRPMKCPSQESPYLFTYRNSNYQSRLLKRQRQHKEREGTEIRCPDKDPSDSTPTSVHRLKPADIKVIGALGDSLTAGNGAGSRPGNILDVLTEYRGLSWSIGADHNISSVTTLPNILREFNPSLKGFSTGTGKANSVGAFFNQAVAGARAGDLIPQARTLVDLMKNHTSINFEEDWKIITVFIGGNDLCDFCSDPVTNSPENFTDNIRQALDILHAEVPRAFVNMVKVLQIVNLRELYKDSRVSCPRLILRNLCRCVLLPDDNSTELESLIDINKKYQERTHQLIESGRYDTREDFTVVLQPFFEKVDIPKTSEGLPDNTSFAPDCFHFSSKTHARAASALWKNMLEPVGQKTTQNNFENSIDIICPNQAFPYLSTYKNGIEGHGTWLTCRERTPSASPPTSVHALRPADVRVVAALGDSLTAGSGIGSKPGDLADVITQYRGLSYSSGGDGSLMNVTTLPNILREFNSNLTGYAVGTGDASNTNAFLNQAVPGAKAEELMSQVKTLVQKMKDDPRINFHEDWKVITVLIGTNDLCNHCTDLDLYSSANFFNHLLNALDILHREVPRALVNLVDFMNPSIMRQVFLGNPDKCPVQQASILCNCVLSLRENSYELARMDALTRAYQSSMRELVESGRYDTREDFSVVLQPFFLNIRLPILEDGRPDTSFFAPDCINPGQKFHSQLSRALWVNMLEPVGSKTDTLDLTADISLPCPTQEEPFLRTPQNSDYTYPTKPAIENWGSDFLCTEWKPSNSVPTSVHKLQPADIKVVAALGDSLTTAVGARASNSSDLLMSWRGLSWSIGGDGALETHTTLPNILKKFNPSIFGFSTGTLEETAGFNVAVEEARARDMPAQARDLVERMKASTEINLEMDWKLITLFIGSNDLCHYCDNPENHSAEEYVQHIRQALDILYEELPRAFINVVDIIMELAGLHQGQGGHCTALLPAQSTCSCLRHFPSSPVIQELKKVTWNLQSDMSRLSYQEKYTQREDFAVVVQPFFQNTLIPLDKLGSTDPTFFSEDCLHFSERGHAEMAIALWNNMLEPVGHKTTFNNFTYNRTKLKCPSTESPYLYTLQNSLSLPVQTEKASGVAPGIVSAAAAGGLLVGLIVGILAVSLWSSFRRRQKKSPPESVPVANF

SEQ ID NO: 69 - protein, 748 aa, Mus musculus; identical to SEQ ID NO: 10

SEQ ID NO: 70 - protein, 165 aa, Homo sapiens
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 71 - protein, 224 aa, Homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 72 - protein, 752 aa, Mus musculus; identical to SEQ ID NO: 44

SEQ ID NO: 73 - protein, 509 aa, Homo sapiens
MGVQAGLFGMLGFLGVALGGSPALRWYRTSCHLTKAVPGNPLGYLSFLAKDAQGLALIHARWDAHRRLQSCSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 74 - protein, 1487 aa, Mus musculus; identical to SEQ ID NO: 5

SEQ ID NO: 75 - protein, 441 aa, Homo sapiens; identical to SEQ ID NO: 64

SEQ ID NO: 76 - protein, 1458 aa, Homo sapiens
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVDHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 77 - protein, 1478 aa, Mus musculus
MELYPGVSPVGLLLLLLLGQGPSQIHGSSGENTLAWQSQQVFWTLKNFPFPCKPKKLELSVLSESVHSLRPSDIKLVAAIGNPEIPLAPGSGTINMEKPQSIKNQPQDVCMGIMTVLSDIIRHFSPSVLMPTCSPGKGTAVHTTAEDLWIQAKELVRRLKDNPQLDFEKDWKLITVFFSNTSQCHLCPSAQQKSHLMRHMEMLWGVLDYLHHEVPRAFVNLVDLSEVLAMDLQHQETGFSPAPEVCKCTETTTLSKAVMQWSYQEAWEDLLASSKFNKHETFAVVFQPFFDEIEPPLKRSSPQDPTTLALRIWNSMMEPVGQKDGLLNTAERKTMKCPSEESPYLFTYKNSNYQARRLKPITKLQMKEGSEFTCPDKNPSNSIPTTVHSLRPADIKIIGALGDSLTAGNGAGASPWNILDVLTEYRGLSWSVGGDETIKTVTTLPNILREFNPSLKGFSVGTGKESTSRASFNQAVAGAKSDGLAGQARKLVDLMKADKTINFQEDWKIITVFIGGNDLCASCSNSTRFSPQNFIDNIKNALDILHAEVPRAFVNMAMVMEITPLRELFNEPTVSCPRNILSRLCPCVLGLGDNSEELSSLVQRNRDYQKKTEELINSGRYDTRDNFTVVVQPLFENVSMPRTPEGVPDKSFFAPDCFHFNAKTHARSAIALWKNMLEPVGHKTRHNNFEIKAPIVCPNQASPFLSTTKNSNLGNGTWMVCEERAPSASPPTSVHTLRPADIQVVAALGDSLTAGNGISSQEGNLTDVSTQYRGLSYSAGGDKTLENVTTLPNILRKFNGNLTGYSVGTGDSSSANAFLNQAVPGAKAENLTSQVRTLVQKMKSDNRVNFNRDWKVITVMIGASDLCDFCTDSNHYSAANFFDHLQNALDILHKEVPRALVNLVDFINPSIIREVFLKNPDKCPVNQSSVLCNCVLTPRKDSYELARLEAFTKSYQSSMLQLVESGRYDTREDFSVVLQPFLLNTKLPVLENGKPDTSFFAPDCIHLNQKFHTQLARALWANMLEPLGKKTDTLDPKGHISLACPTKDQPFLRTFRNSNYKYPTKPAIENWGSDFLCTEKSPSSQVPTSVHELRPADIKVVAAMGDFLTTATGARPSGYKRLATPWRGLSWSIGGDGKLETHTTLPNILKKFNPSITGFSTGTLDNKAGLNVAEEGARAQDMPAQAKTLVKKMKSTPTINLQEDWKLITLLIGNNDLCLYCENPEDNSTKEYVKYIQQALDILYEELPRVFINVVEVMELAGLHHVQGGKCAMPLAVQKNCSCLRHSQNLTAMQELKKLNWNLQSGISELSYWHRYMEREDFAVTVQPFFRNTFIPLNEREGLDLTFFSEDCFYFSDRGHAEMAIALWNNMLEPVGWKTSSNNFIYNRTKLKCPSPERPFLYTLRNSQLLPDKAEEPSNALYWAVPVAAIGGLAVGILGVMLWRTVKPVQQEEEEEDTLPNTSVTQDAVSEKRLKAGN

SEQ ID NO: 78 - protein, 1458 aa, Oryctolagus cuniculus
MALWPSVFLLGLLPLLGRGADQIQTSSGKNTLEGQLWPESLKTFPFPCDPKTLAESVPSESVHSLRPSDIKFVAAIGNVETAPDSGADDLEEQDGTEKRPEQACMGVVTVLSDIIGRFSPSALMPLCPETRLVPRGGAEDLWMQATELVRSMRENPQLDFEHDWKLINVFFSNTSQCFPCPSAQQKGLVLGGMDKLTRTLDYLQQEVPKAFVNLVDLSELAAFSRWRQGAQLSPAAEPCRCLRETSQLTKVLTQWSYLEAWDSLLASSKYNTQESFAVVFQPFFYESSLSALLAEPPLQDPTTLALSLWNRMMEPIGRKEEPFSEKERKPLRCPTQESPYLFTYRNSGQLTRVSQPQGKLEVREGTEIRCPDKDPSDSVPTSVHRLKPADIKVIGAMGDSLTAGNGAGSQPGNILDVLTQYRGLSWSVGGDQNISTVTTLANILREFNPSLQGFSVGTGRETTSQAFFNQAVAGARADGLIPQAQRLVALMKNDTRINFQEDWKIITVFIGGNDLCDFCNDPVRYSPQNFTDNIGTALDILHAEIPRAFVNLVKVLEISKLRELYQETKVSCPRMILRSLCPCVLKFDDNSTEIASLIETIKEYQERTQQLIDSGRYDTRDDFTVVLQPFFEKVNMPKTQDGLPDNSFFAPDCFHFSSKAHAHAASALWNNMLEPVGQKTTHNDFEGAVNITCPNQVWPFLSTYKNSVQGFGTWLPCRDRSPSASPPTSVHALRPADIQVVAALGDSLTAGIGIGSKPNDLSDGTTQYRGLSYSSGGDGSLDNVTTLPNILRQFNSNLMGFAVGTGDASGTNAFFNQAVPGAKARDLMSQVQTLVQRMKDDHRVNFQEDWKVITVQIGASDLCDYCTDSNLYSAANFYDHLRDALDALHREVPRALVNLVDFMNPSVTRQVFLGNPDKCPVQQASALCNCVLSPRENSYELARLEALAQAYQSSLRELVESGRYDTREDFSVVLQPFFHSIQLPVLQDGRLDTSFFAPDCVHPNQKFHSQLSRALWRNMLEPLGGKTDALDLTAAITLTCPTQNEPFLRTFRNSDYTYPSRPAVENWGSDFLCTAWNASRGVPNSVHELQPGDIKVVAALGDSLTLAMGARPSNSSDPPMFWRGLSWSIGGDGALETHTTLPNILKKFNPSILGFSTGTLEGTMGLNVAVQGARAQDMPAQARDLVERMRNSPEIDLEKDWKLVTLFVGGNDLCHFCENPEGSSEGEYVQHIQQALDVLYEELPRTFVNVVEVMELAGLHQDQGGRCATLLAAQSHCTCFKYSQSSVEMQELKKVNWNLQSGLSRLSYSHQYVQREDFAVVVQPFFQNTLVPLNGRGDTDLTFFSDDCFHFSERGHAEMAIALWNNMLEPVGHKTTSNNFTYSRTKLKCPSPDSPYLYTLRNSRLLPDQAEADPTVLYWAVPVAAGAGLLIGILAMVAGRGMRCRPREDPPLSLSTGL

SEQ ID NO: 79 - protein, 1324 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 80 - protein, 189 aa, Homo sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 81 - protein, 1463 aa, Homo sapiens; identical to SEQ ID NO: 8

SEQ ID NO: 82 - protein, 1474 aa, Monodelphis domestica
MRLQPSLLLLALLLLKVTTIQATLGNNSWEEQTWPEGLKNFPFPCRPEEIPFSPPSESVHSLRISDIRVVGAIGNLETTPDAKMVLKRQKWIERNQMQTCMQVMTVLSDFIKKFSPSVLPLLCPSREKVLPRMRNEDLGPQARELVQHMKKNQKLNFRNDWKLINVFFNAQSQCHPCSSSQKEGNMTSSMQELIRLLDYLQKEVPKAFVNLVDISELGNSIQSNNQENGPRDINEVCECPQEPSRLTTAVQRWYYQNSWEKLLTSGRYDTKDTFTVIYQSFLHEMEPSVFPIKQTSGSSLKKLSTALAVSLWNGMIDPTGKKEEFFTTGQRIPVKCPTQKHPYLFTYRNNNKLSSTPEIKRISETREGTEIRCPDMDPSNAVPTSVHHLRPADIKVIGALGDSLTAGNGAGSTPGNILDVLTQYRGLSWSIGGNENISTVTTLANILREFNPSLIGFSTGTGNQNSAAAFLNQAVAGATSETLPSQARRLVDLMKENKRINFQDDWKIVTLFIGGNDLCDSCSDPPRYSSQNFTAHIGKALDILHAEVPRVFVNLVTVLSIVSLRELYQEESINCPRVILRSLCPCVLKFKDNSTELTTLIELNKQYQEETHRLVDSGRYDTRDDFTVVLQPFLEQVPMPKTPEGLPDSSFFAPDCFHFHSKAHARVARSLWNNMLEPVGEKKKEENLENIVDLICPSESQPYLRTYKNSNYTYPTATPTSSPKPDYGSQLWCEDRAPSASFPTSVHALKPADIQVVAAVGDSLTAGNGIGSKPDDLPDVITQYRGLSYSAGGDASLESVTTLPNILREFNMNLTGFAVGVGSADDANAFLNQAVPGAKAEGLKKQVQTLVQKMKSDPRINFQRDWKVITLLIGTTDLCDYCTDSNLYSATNFSAYLRDALDFLHREVPRALVNLVDFMNPIIFRQVFLGNQDKCPMTQACSLCNCLLTVREDSPELARMKEVVKVYQTKIRELVESGRYDTREDFTIVLQPFLEEVKLAFQDGIPDVSFFAPDCIHPNQKFHSQLSRALWNNMLQPLGKKMDFLDLTADTTLSCPSLEEPFLRTYRNSNYTYPANPAIENWGSDFLCPEQGSSNSAPSSVHQLRPADIKVVAALGDSLTTAVGAGAKNNSNWSTAWRGLSWSIGGDGTLETHTTLPNILKKFNPHLHGFSTGTQEEAAGLNVAVEGAIAQDMPSQARILVDRMKNSSEINLDQDWKLITIFVGSNDLCQYCENPEAHSVKNYVQSLQQALDIFYKELPRAFINVVEIMELVGLRQIQGEKCAVTTQSICPCFGRSLDNSPELQEMKNINRHFQSGSSLITYHHQYMEREDFAVVVQPFFQSTVVPLDDKGKPDLSFFSVDCFHFSERGHAEMAIALWNNMLEPVGQKQTYNNFTHSRTKVKCPTSENPYFFTMRNSGLLRKEASHKTPSVPFWAVLVAAAASFIVGVVLVMLWRTKKCSRREERPISLVATVF

SEQ ID NO: 83 - protein, 493 aa, Homo sapiens
MIAFLLTSVLMIPHAGGHPLDTPHLPQELPPGLPNNINITFFSGMFKNVESVAEIFDCLGAHFTWLQAVFTNFPVLIQFVNGMKCVAGLCPRDFEDYGCTCRFEMEGLPVDESDSCCFQHRRCCEEAAEMDCLQDPAKLSTEVDCVGKKIICESKDNCEHLLCTCDKAAIECLARSSLNSSLNLLDTSFCLAQTPETTIKEDLTTLLPRVVPVEPTDTSLTALSGEVAAETEADRLITLSKKKAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 84 - protein, 504 aa, Homo sapiens
MFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQLAGPAPLLSTPAPEARPVIGALGL

SEQ ID NO: 85 - protein, 151 aa, Rattus norvegicus; identical to SEQ ID NO: 49

SEQ ID NO: 86 - protein, 124 aa, Homo sapiens [sequence omitted]

SEQ ID NO: 87 - protein, 1487 aa, Mus musculus; identical to SEQ ID NO: 5

SEQ ID NO: 88 - protein, 189 aa, Homo sapiens; identical to SEQ ID NO: 80

SEQ ID NO: 89 - protein, 195 aa, Homo sapiens
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEAACDSLVDTVFNTVWTLGCRPFMNSQRAACICAEEEKEEL

SEQ ID NO: 90 - protein, 195 aa, Mus musculus
MKLLCGFFLLWLGLVGNLAQSDPSPKEEESYSDWGLRQLRGSFESVNSYVDSFMELLGGKNGVCQYRCRYGKAPMPRPGYKAQEPNGCSSYFLGIKVPGSMDLGIPAMTKCCNQLDVCYDTCGANKYRCDAKFRWCLHSICSDLKRSLGFVSNVEAACDSLADTVFNTVWTLGCRPFMNSQRAACICAEEEKEEL

SEQ ID NO: 91 - protein, 192 aa, Mus musculus
MVTPRPAPARSPALLLLLLLATARGQEQDQTTDWRATLKTIRNGIHKIDTYLNAALDLLGGEDGLCQYKCSDGSKPVPRYGYKPSPPNGCGSPLFGVHLNIGIPSLTKCCNQHDRCYETCGKSKNDCDEEFQYCLSKICRDVQKTLGLSQNVQACETTVELLFDSVIHLGCKPYLDSQRAACWCRYEEKTDL

SEQ ID NO: 92 - protein, 144 aa, Mus musculus
MRLALLCGLLLAGITATQGGLLNLNKMVTHMTGKKAFFSYWPYGCHCGLGGKGQPKDATDWCCQKHDCCYAHLKIDGCKSLTDNYKYSISQGTIQCSDNGSWCERQLCACDKEVALCLKQNLDSYNKRLRYYWRPRCKGKTPAC

SEQ ID NO: 93 - protein, 855 aa, Mus musculus
MPWTLQPKWLAGKGLPLLGAILLRKTEKSEPQWKHRRQETHPYYDLQVKVLRARNIQHTDKLSKADCYVRLWLPTASVSPSQTRTVVNSSDPEWNETFPYQIHGAVKNVLELALYDEDVLDSDNVFSILFDTSTLQLGQPCTKNFTRQQDPKELEVEFTLEKSQTPASEVVTNGVLVAHPCLRIQGTVTGDKTASLGELGSRQIQLAVPGAYEKPQPLQPTSEPGLPVNFTFHVNPVLSPKLHIKLQEQLQVFHSGPSDELEAQTSKMDKASILLSSLPLNEELTKLVDLEEGQQVSLRMKADMSSSGDLDLRLGFDLCDGEQEFLDKRKQVASKALQRVMGLSEALHCDQVPVVAVLGSGGGTRAMTSLYGSLAGLQELGLLDAVTYLSGVSGSSWCISTLYRDPSWSQKALQGPIKYASERVCSSKIGMLSPKQFEYYSREKRAWESRGHSMSFTDLWGLIIEYFLNQEENPAKLSDQQETVSQGQNPYPIYASINVHKNISGDDFAEWCEFTPYEVGFPKYGAYVPTELFGSEFFMGRLLHFWPEPRICYLQGMWGSAFAASLYEIFLKLGGLSLSFLDWHRGSVSVTDDWPKLRKQDPTRLPTRLFTPMSSFSQAVLDIFTSRITCAQTFNFTRGLCMYKDYTARKDFVVSEDAWHSHNYGYPDACPNQLTPMKDFLSLVDGGFAINSPFPLVLQPQRAVDLIVSFDYSLEGPFEVLQVTEKYCRDRGIPFPRIEVDPKDSEDPRECYLFAEAEDPCSPIVLHFPLVNRTFRTHLAPGVERQTAEEKAFGDFIINGPDTAYGMMDFTYEPKEFDRLVTLSRYNVLNNKETIRHALQLALDRRRQAGGRVGG

SEQ ID NO: 94 - protein, 440 aa, Mus musculus
MVPLKLQALFCLLCCLPWVHPFHWQDTSSFDFRPSVMFHKLQSVMSAAGSGHSKIPKGNGSYPVGCTDLMFGYGNESVFVRLYYPAQDQGRLDTVWIPNKEYFLGLSIFLGTPSIVGNILHLLYGSLTTPASWNSPLRTGEKYPLIVFSHGLGAFRTIYSAIGIGLASNGFIVATVEHRDRSASATYFFEDQVAAKVENRSWLYLRKVKQEESESVRKEQVQQRAIECSRALSAILDIEHGDPKENVLGSAFDMKQLKDAIDETKIALMGHSFGGATVLQALSEDQRFRCGVALDPWMYPVNEELYSRTLQPLLFINSAKFQTPKDIAKMKKFYQPDKERKMITIKGSVHQNFDDFTFVTGKIIGNKLTLKGEIDSRVAIDLTNKASMAFLQKHLGLQKDFDQWDPLVEGDDENLIPGSPFDAVTQVPAQQHSPGSQTQN

SEQ ID NO: 95 - protein, 150 aa, Homo sapiens
MLIATSFFLFFSSVVAAPTHSSFWQFQRRVKHITGRSAFFSYYGYGCYCGLGDKGIPVDDTDSPSSPSPYEKLKEFSCQPVLNSYQFHIVNGAVVCGCTLGPGASCHCRLKACECDKQSVHCFKESLPTYEKNFKQFSSQPRCGRHKPWC

SEQ ID NO: 96 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 97 - protein, 145 aa, Homo sapiens
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 98 - protein, 168 aa, Homo sapiens
MKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYEPPPEEVTCSHQSPAPPAPP

SEQ ID NO: 99 - protein, 124 aa, Sus scrofa
ALWQFRSMIKCTIPGSDPLLDFNNYGCYCGLGGSGTPVDELDRCCETHDNCYRDAKNLDSCKFLVDNPYTNSYSYSCSNTEITCNSKNNACEAFICNCDRNAAICFSKAPYNKEHKNLDTKKYC

SEQ ID NO: 100 - protein, 791 aa, Mus musculus
MALQTCPVYMQAKVPETCLLTVRVLRASGLPSKDLVTSSDCYVTLNLPTASSHTLQTRTVKNSRNPVWNQNFHFRIHRQLKNVMELKVFDHDLVTRDDPVLSVLFDVGTLQIGTQRQSFSLGTQEKGCLEVEFRLQTLTDCEEQLISNGIVVARELSCLHVELKRTGDPKRSERKVQLVVAGACEGPQDASAGTGSFHFHYPACWEQELNVHLQDDPHEQLKVPLRTLPSSQLVRLVFPTSQEPLMRLELKKEEGPKELAVRLGCGPCPEEQAFLSKRKQVVAAALKKALQLDQDLHEDEIPVIAVMATGGGIRAMTSLYGQLAGLQELGLLDCISYITGASGSTWALANLYEDPEWSQKDLAGPTEVLKTQVTKSKLGALAPSQLWRYRQELAERARLGHPTCFTNLWALINEALLHDKPHEHKLSDQREALSRGQNPLPIYCALNSKEQGLSTFDFGEWCEFSPYEVGFPKYGAFISSELFGSEFFMGRLVKQLPESRICFLEGIWSNLFAASLQDSLYWSSEPSQFWDRWAQDQANLDKEQVPHLKIAEPPTMAGRIAELFTDLLTKRPLAHATHNFTRGLHFHKDYFQNSHFSAWKASKLDRLPNQLTPTEPHLCLLDVGYLINTSCPPLLQPTRDVDLILSLDYNLYGAFQQLQLLSRFCQEQGIPFPSISPSPEEQRQPQECHLFCDPAQPEAPAVLHFPLVNDSFQDYSAPGVPRTSEEKAAGEVNLSSSDSPYHYTKVTYSQEDVDKLLRLTHYNICNNQDRLREAMHQAVQRRRKRKQFRPE

SEQ ID NO: 101 - protein, 224 aa, Rattus norvegicus
MPGGLLLGDEAPNFEANTTIGHIRFHDFLGDSWGILFSHPRDFTPVCTTELGRAAKLAPEFAKRNVKLIALSIDSVEDHFAWSKDINAYNGAAPTEKLPFPIIDDKDRDLAILLGMLDPAEKDEKGMPVTARVVFIFGPDKKLKLSILYPATTGRNFDEILRVVDSLQLTASNPVATPVDWKKGESVMVLPTLPEEEAKQLFPKGVFTKELPSGKKYLRYTPQP

SEQ ID NO: 102 - protein, 224 aa, Bos taurus
MPGGLLLGDEAPNFEANTTIGRIRFHDYLGDSWGILFSHPRDFTPVCTTELGRAAKLAPEFAKRNVKMIALSIDSVEDHLAWSKDINAYNGEEPTEKLPFPIIDDKNRDLAIQLGMLDPAEKDEKGMPVTARVVFIFGPDKKLKLSILYPATTGRNFDEILRVIISLQLTAEKRVATPVDWKNGDSVMVLPTIPEEEAKKLFPKGVFTKELPSGKKYLRYTPQP

SEQ ID NO: 103 - protein, 1463 aa, Bos taurus; identical to SEQ ID NO: 11

SEQ ID NO: 104 - protein, 855 aa, Mus musculus
MPWTLQPKWLAGKGLPLLGAILLRKTEKSEPQWKHRRQETHPYYDLQVKVLGARNIQHTDKLSKADCYVRLWLPTASVSPSQTRTVVNSSDPEWNETFHYQIHGAVKNVLELALYDEDVLDSDNVFSILFDMSTLQLGQPCTKNFTRQQDPKELEVEFTLEKSQTPASEVVTNGVLVAHPCLRIQGTVTGDKTASLGELGSRQIQLAVPGAYEKPQPLQPTSEPGLPVNFTFHMNPVLSPKLHIKLQEQLQVFHSGPSDELEAQTSKMDKASILLSSLPLNEELTKLVDLEEGQQVTLRMKADMSSSGDLDLRLGFDLCDGEQEFLDKRKQVASKALQRAMGLSEALHCDQVPVVAVLGSGGGTRAMTSLYGSLAGLQELGPLDAVTYLSGVSGSSWCISTLYRDPSWSQKALQGPIKYASERVCSSKIGMLSPKQFEYYSREKRAWESRGHSMSFTDLWGLIIEYFLNQEENPAKLSDQQETVSQGQNPYPIYASINVHKNISGDDFAEWCEFTPYEVGFPKYGAYVPTELFGSEFFMGRLLHFWPEPRICYLQGMRGSAFAASLYGIFLKLGGLSLSFLDWHRGSVSVTDDWPKLRKQDPTRLPTRLFTPMSSFSQAVLDIFTSRITCAQTFNFTRGLCMYKDYTARKDFVVSEDAWHSHNYGYPDACPNQLTPMKDFLSLVDGGFAINSPFPLVLQPQRAVDLIVSFDYSLEGPFEVLQVTEKYCRDRGIPFPRIEVDPKDSEDPRECYLFTEAEDPCSPIVLHFPLVNRTFRTHLAPGVERQTAEEKAFEDFIINGPDTAYGMMDFTYEPKEFDRLVTLSRYNVLNNKETIRHALQLALDRRRQAGGRVGG

SEQ ID NO: 105 - protein, 782 aa, Mus musculus
MQAKVPETCLLTVRVLRASGLPSKDLVTSSDCYVTLNLPTASSHTLQTRTVKNSRNPVWNQNFHFRIHRQLKNVMELKVFDHDLVTRDDPVLSVLFDVGTLQIGTQRQSFSLGTQEKGCLEVEFRLQTLTDCEEQLISNGIVVARELSCLHVELKRTGDPKRSERKVQLVVAGACEGPQDASAGTGSFHFHYPACWEQELNVHLQDDPHEQLKVPLRTLPSSQLVRLVFPTSQEPLMRLELKKEEGPKELAVRLGCGPCPEEQAFLSKRKQVVAAALKKALQLDQDLHEDEIPVIAVMATGGGIRAMTSLYGQLAGLQELGLLDCISYITGASGSTWALANLYEDPEWSQKDLAGPTEVLKTQVTKSKLGALAPSQLWRYRQELAERARLGHPTCFTNLWALINEALLHDKPHEHKLSDQREALSRGQNPLPIYCALNSKEQGLSTFDFGEWCEFSPYEVGFPKYGAFISSELFGSEFFMGRLVKQLPESRICFLEGIWSNLFAASLQDSLYWSSEPSQFWDRWAQDQANLDKEQVPHLKIAEPPTMAGRIAELFTDLLTKRPLAHATHNFTRGLHFHKDYFQNSHFSAWKASKLDRLPNQLTPTEPHLCLLDVGYLINTSCPPLLQPTRDVDLILSLDYNLYGAFQQLQLLSRFCQEQGIPFPSISPSPEEQRQPQECHLFCDPAQPEAPAVLHFPLVNDSFQDYSAPGVPRTSEEKAAGEVNLSSSDSPYHYTKVTYSQEDVDKLLRLTHYNICNNQDRLREAMHQAVQRRRKRKQFRPE

SEQ ID NO: 106 - protein, 887 aa, Homo sapiens [sequence omitted]

SEQ ID NO: 107 - protein, 752 aa, Rattus norvegicus
MSFIDPYQHIIVEHQYSHKFTVVVLRATKVTKGTFGDMLDTPDPYVELFISTTPDSRKRTRHFNNDINPVWNETFEFILDPNQENVLEITLMDANYVMDETLGTATFPVSSMKVGEKKEVPFIFNQVTEMILEMSLEVSSCPDLRFSMALCDQEKTFRQQRKENIKENMKKLLGPKKSEGLYSTRDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGLPVTFTDIFGMLIGETLIQNRIVPTLSSLKEKVSAARCPLPLFTCLHVKPDVSELMFADWVEFSPYEIGMAKYGTFMTPDLFGSKFFMGTVVKKYEENPLHFLMGVWGSAFSILFNRVLGVSGLQNKGSTMEEELENITAKHIVSNDSSDSDDEAQGPKGTENEDAEREYQNDNQASWVHRMLMALVSDSALFNTREGRAGKVHNFMLGLNLNTSYPLSPLRDFSPQDSFDDDELDAAVADPDEFERIYEPLDVKSKKIHVVDSGLTFNLPYPLILRPQRGVDLIISFDFSARPSDTSPPFKELLLAEKWAKMNKLPFPKIDPYVFDREGLKECYVFKPKNPDVEKDCTTIIHFVLANINFRKYKAPGVLRETKEEKEIADFDIFDDPESPFSTFNFQYPNQAFKRLHDLMYFNTLNNIDVIKDAIVESIEYRRQNPSRCSVSLSNVEARKFFNKEFLSKPTAESI

SEQ ID NO: 108 - protein, 776 aa, Mus musculus
MSINLTLDIYIYFLNNARSLCGKQRSKQLHFVCSKQYWRMNHVNVHREFHTSKKSCKWNRSEAHCSKHWHSPSNHGLHFGIVRLSTSAPKGLTKVSIHMSRIKSTLNSVSKAIFGSQNEMVTRLAQFKPSSRILRKVSDKGWLKQKNVKQAVESLKNYSDKSAGKNSLAEQKSYFADKEEDSGKHSLFHYTYGITTRFGESFSVLANHINSYFKSKGKMSQTKEDKQLQDKPDLEERKSSSPGPDTVADRPDSESPLEVKDKLSSPTQMPEAHPVSAKQSIANFLSRPTEGVQALVGGYIGGLVPKLKSDPKSPPEEQEVSAKTEQAVNKDKKAEEKKRVLLQQEKIIARVSIDNRTRALVQALRRTADPKLCITRVEELTFHLLEFPEGKGVAIKEKIIPYLLRLRQVKDETLQAAVREILALIGYVDPVKGRGIRILTIDGGGTRGVVALQTLRKLVELTQKPIHQLFDYICGVSTGAILAFMLGLFHMPLDECEELYRKLGSDVFTQNVIVGTVKMSWSHAFYDSNTWEKILKDRIGSALMIETARNPACPKVAAISTIVNRGQTPKAFVFRNYGHFPGTNSHYLGGCQYKMWQAIRASSAAPGYFAEYALGSDLHQDGGLLLNNPSALALHECKCIWPDTPLECIVSLGTGRYESDVRNTSTYTSLKTKLSNVISSATDTEEVHIMLDGLLPSDTYFRFNPVICENIPLDESRDEKLDQLQLEGMKYIERNDQKMKKVAKILSQEKTTLQKINDWIKLKSDMYEGLPFFSKL

SEQ ID NO: 109 - protein, 224 aa, Mus musculus
MPGGLLLGDEAPNFEANTTIGRIRFHDFLGDSWGILFSHPRDFTPVCTTELGRAAKLAPEFAKRNVKLIALSIDSVEDHLAWSKDINAYNGETPTEKLPFPIIDDKGRDLAILLGMLDPVEKDDNNMPVTARVVFIFGPDKKLKLSILYPATTGRNFDEILRVVDSLQLTGTKPVATPVDWKKGESVMVVPTLSEEEAKQCFPKGVFTKELPSGKKYLRYTPQP

SEQ ID NO: 110 - protein, 782 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 111 - protein, 412 aa, Homo sapiens; identical to SEQ ID NO: 1

SEQ ID NO: 112 - protein, 168 aa, Mus musculus
MKKFFAIAVLAGSVVTTAHSSLLNLKSMVEAITHRNSILSFVGYGCYCGLGGRGHPMDEVDWCCHAHDCCYEKLFEQGCRPYVDHYDHRIENGTMIVCTELNETECDKQTCECDKSLTLCLKDHPYRNKYRGYFNVYCQGPTPNCSIYDPYPEEVTCGHGLPATPVST

SEQ ID NO: 113 - protein, 142 aa, Mus musculus
MKPPIALACLCLLVPLAGGNLVQFGVMIERMTGKPALQYNDYGCYCGVGGSHWPVDETDWCCHAHDCCYGRLEKLGCDPKLEKYLFSITRDNIFCAGRTACQRHTCECDKRAALCFRHNLNTYNRKYAHYPNKLCTGPTPPC

SEQ ID NO: 114 - protein, 142 aa, Homo sapiens
MKSPHVLVFLCLLVALVTGNLVQFGVMIEKMTGKSALQYNDYGCYCGIGGSHWPVDQTDWCCHAHDCCYGRLEKLGCEPKLEKYLFSVSERGIFCAGRTTCQRLTCECDKRAALCFRRNLGTYNRKYAHYPNKLCTGPTPPC

SEQ ID NO: 115 - protein, 230 aa, Oryctolagus cuniculus
MCGNNMSAPMPAVVPAARKATAAVIFLHGLGDTGHGWAEAFAGIKSPHIKYICPHAPVMPVTLNMNMAMPSWFDIVGLSPDSQEDESGIKQAAETVKALIDQEVKNGIPSNRIILGGFSQGGALSLYTALTTQQKLAGVTALSCWLPLRASFSQGPINSANRDISVLQCHGDCDPLVPLMFGSLTVERLKALINPANVTFKIYEGMMHSSCQQEMMDVKHFIDKLLPPID

SEQ ID NO: 116 - protein, 412 aa, Mus musculus
MDRHLCTCRETQLRSGLLLPLFLLMMLADLTLPAQRHPPVVLVPGDLGNQLEAKLDKPKVVHYLCSKKTDSYFTLWLNLELLLPVIIDCWIDNIRLVYNRTSRATQFPDGVDVRVPGFGETFSMEFLDPSKRNVGSYFYTMVESLVGWGYTRGEDVRGAPYDWRRAPNENGPYFLALREMIEEMYQMYGGPVVLVAHSMGNVYMLYFLQRQPQVWKDKYIHAFVSLGAPWGGVAKTLRVLASGDNNRIPVIGPLKIREQQRSAVSTSWLLPYNHTWSHEKVFVYTPTTNYTLRDYHRFFRDIGFEDGWFMRQDTEGLVEAMTPPGVELHCLYGTGVPTPNSFYYESFPDRDPKICFGDGDGTVNLESVLQCQAWQSRQEHRVSLQELPGSEHIEMLANATTLAYLKRVLLEP

SEQ ID NO: 117 - protein, 1458 aa, Oryctolagus cuniculus; identical to SEQ ID NO: 13

SEQ ID NO: 118 - protein, 666 aa, Oryctolagus cuniculus
  misc_feature (278)..(278): Xaa can be any naturally occurring amino acid
MPPSCRPSTRAPSRSCTLRSCSTCPTSSATTPAGRWRTWPWRLGIRECFHHSRIISCANSTENEEGCTPLHLACRKGDGEILLELVQYCHAQMDVTDNKGETAFHYAVQGDNSQVLQLLGKNASTGVNQVNSQGLTPLHLACQMGKQEMVRVLLLCNARCNILGPEGYPIHTAMKFSQRGCAEMIISMDSNQIHSKDPRYGASPLHWAKNAEMARLLLKRGCDVNSTSSSGYTALHVAVMRNRFECVMVLLTYGANADARGEHGNTPLHLAVSKDNVXMVKALIVFGAEVDTPNDFGETPAFIASKISKQLQDVMHISRARKPAFILSSLRDEKRTHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPESVREPRFSPNINLKPLTQPSDQLVWRAARSSGAAPTYFRPNGRFLDGGLLANNPTLDAMTEIHEYNQDLIRKGQSERVKKLSIVVSLGTGRSPQVPVTCVDVFRPSNPWELAKTVFGAKELGKMVVDCCTDPDGRAVDRARAWCEMVGIQYFRLNPQLGADIMLDEVSDAVLVNALWETEVYIYEHREQFQKLIQLLLSP

SEQ ID NO: 119 - protein, 806 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIHLLLSP

SEQ ID NO: 120 - protein, 346 aa, Bos taurus
MAMVSEFLKQAWFIENEEQEYIKTVKGSKGGPGSAVSPYPTFNPSSDVEALHKAITVKGVDEATIIEILTKRNNAQRQQIKAAYLQEKGKPLDEVLKKALLGHLEEVVLALLKTPAQFDAEELRAAMKGLGTDEDTLNEILASRTNREIREINRVYREELKRDLAKDIASDTSGDYEKALLSLAKGDRSEELAVNDDLADSDARALYEAGERRKGTDVNVFITILTTRSYPHLRRVFQKYSKYSKHDMNKVLDLELKGDIEKCLTVIVKCATSQPMFFAEKLHQAMKGIGTRHKTLIRIMVSRSEIDMNDIKACYQKLYGISLCQAILDETKGDYEKILVALCGRD

SEQ ID NO: 121 - protein, 346 aa, Sus scrofa
MAMVSEFLKQAWFIDNEEQEYIKTVKGSKGGPGSAVSPYPTFNPSSDVEASHKAITVKGVDEATIIEIHTKRTNAQRQQIKAAYLQEKGKPLDEALKKALTGHLEEVALALLKTPAQFDADELRAAMKGLGTDEDTLNEILASRTNREIREINRVYKEELKRDLAKDITSDTSGDYQKALLSLAKGDRSEDLAINDDLADTDARALYEAGERRKGTDLNVFITILTTRSYLHLRRVFQKYSKYSKHDMNKVLDLELKGDIENCLTVVVKCATSKPMFFAEKLHQAMKGNGTRHKTLIRIMVSRSEIDMNDIKACYQKLYGISLCQAILDETKGDYEKILVALCGGD

SEQ ID NO: 122 - protein, 346 aa, Oryctolagus cuniculus
MAMVSEFLKQAWFIDNEEQDYINTVKTYKGGPGSAVSPYPAFNPSSDVAALHQAIMVKGVDEATIIDILTKRNNAQRQQIKAAYLQEKGKPLDEVLKKALTGHLEEVVLALLKTPAQFDADELRAAMKGLGTDEDTLIEILASRNNKEIREINRVYREELKRDLAKDIASDTSGDFQKALLSLAKGDRSEDFGVNEDLADTDARALYEAGERRKGADVNVFTTILTTRSYLHLRRVFQKYSKYSQHDMNKVLDLELKGDIEKCLTAIVQCATCKPAYFAEKLYQAMKGAGTRHKALIRIMVSRSEVDMNDIKAFYQKKYGVSLCQAILDETKGDYEKILVALCGGN

SEQ ID NO: 123 - protein, 346 aa, Rattus norvegicus
MAMVSEFLKQACYIEKQEQEYVQAVKSYKGGPGSAVSPYPSFNPSSDVAALHKAIMVKGVDEATIIDILTKRTNAQRQQIKAAYLQETGKPLDETLKKALTGHLEEVVLAMLKTPAQFDADELRAAMKGLGTDEDTLIEILTTRSNQQIREITRVYREELKRDLAKDITSDTSGDFRNALLALAKGDRCEDMSVNQDLADTDARALYEAGERRKGTDVNVFNTILTTRSYPHLRKVFQNYRKYSQHDMNKALDLELKGDIEKCLTTIVKCATSTPAFFAEKLYEAMKGAGTRHKTLIRIMVSRSEIDMNEIKVFYQKKYGIPLCQAILDETKGDYEKILVALCGGN

SEQ ID NO: 124 - protein, 346 aa, Cavia cutleri
MSMVSEFLKQAYFIDNQEQDYVKTVKSSKGGPGSAVSPYPSFDASSDVAALHKAITVKGVDEATIIDILTKRNNAQRQQIKAAYLQEKGKPLDEALKKALTGHLEEVVLALLKTPAQLDADELRAAMKGLGTDEDTLIEILVSRKNREIKEINRVYRDELKRDLAKDITSDTSGDFQKALLSLAKGDRCEDLSVNDDLADSDARALYEAGERRKGTDVNVFITILTTRSYSHLRRVFQKYTKYSQHDMNKALDLELKGDIENCLTAIVKCATSTPAFFAEKLHLAMKGAGTRHKALIRIMVSRSEIDMNDIKVYYQKMYGISLCQAILDETKGDYEKILVALCGGQ

SEQ ID NO: 125 - protein, 392 aa, Homo sapiens
MGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEWIPFRRVEEGEKEFHVRNPQVHQRVSECLRVLKILQEVTAGQTVFNILPGGLDLMTLKGNIDMSRVAVMGHSFGGATAILALAKETQFRCAVALDAWMFPLERDFYPKARGPVFFINTEKFQTMESVNLMKKICAQHEQSRIITVLGSVHRSQTDFAFVTGNLIGKFFSTETRGSLDPYEGQEVMVRAMLAFLQKHLDLKEDYNQWNNLIEGIGPSLTPGAPHHLSSL

SEQ ID NO: 126 - protein, 440 aa, Mus musculus
MVPLKLQALFCLLCCLPWVHPFHWQDTSSFDFRPSVMFHKLQSVMSAAGSGHSKIPKGNGSYPVGCTDLMFGYGNESVFVRLYYPAQDQGRLDTVWIPNKEYFLGLSIFLGTPSIVGNILHLLYGSLTTPASWNSPLRTGEKYPLIVFSHGLGAFRTIYSAIGIGLASNGFIVATVEHRDRSASATYFFEDQVAAKVENRSWLYLRKVKQEESESVRKEQVQQRAIECSRALSAILDIEHGDPKENVLGSAFDMKQLKDAIDETKIALMGHSFGGATVLQALSEDQRFRCGVALDPWMYPVNEELYSRTLQPLLFINSAKFQTPKDIAKMKKFYQPDKERKNDYNQGLRHQNFDDFTFVTGKIIGNKLTLKGEIDSRVAIDLTNKASMAFLQKHLGLQKDFDQWDPLVEGDDENLIPGSPFDAVTQAPAQQHSPGSQTQN

SEQ ID NO: 127 - protein, 444 aa, Canis familiaris
MLPPKLHALFCLCSCLTLVHPIDWQDLNPVAHIRSSAWANKIQALMAAASIRQSRIPKGNGSYSVGCTDLMFDYTNKGTFLRLYYPSQEDDHSDTLWIPNKEYFFGLSKYLGTPWLMGKILSFFFGSVTTPANWNSPLRTGEKYPLIVFSHGLGAFRTIYSAIGIDLASHGFIVAAIEHRDGSASATYYFKDQSAAEIGNKSWSYLQELKPGDEEIHVRNEQVQKRAKECSQALNLILDIDHGRPIKNVLDLEFDVEQLKDSIDRDKIAVIGHSFGGATVLQALSEDQRFRCGIALDAWMLPLDDAIYSRIPQPLFFINSERFQFPENIKKMKKCYSPDKERKMITIRGSVHQNFADFTFTTGKIVGYIFTLKGDIDSNVAIDLCNKASLAFLQKHLGLRKDFDQWDSLIEGKDENLMPGTNINITNEHDTLQNSPEAEKSNLD

SEQ ID NO: 128 - protein, 444 aa, Bos taurus
MLPSKLHALFCLCTCLALVYPFDWQDLNPVAYIESPAWVSKIQALMAAANIGQSKIPRGNGSYSVGCTDLMFDYTNKGTFLRLYYPSQDDDHSDTLWIPNKEYFLGLSKFLGTHWLVGKIMGLFFGSMTTPAAWNAHLRTGEKYPLIIFSHGLGAFRTIYSAIGIDLASHGFIVAAVEHRDGSASSTYYFKDQSAVEIGNKSWLYLRTLKRGEEEFPLRNEQLRQRAKECSQALSLILDIDHGRPVTNVLDLEFDVEQLKDSIDRDKIAIIGHSFGGATVIQTLSEDQRFRCGIALDAWMFPVGDEVYSRIPQPLFFINSERFQYPSNIIRMKKCFLPDRERKMITIRGSVHQNFVDFTFATSKIIGYLFTLKGDIDSNVAISLSNKASLAFLQKHLGLQKDFDQWDSLVEGEDHNLIPGTNINTTNHQAILQNSTGIERPNLD

SEQ ID NO: 129 - protein, 776 aa, Mus musculus; identical to SEQ ID NO: 108

SEQ ID NO: 130 - protein, 346 aa, Mus musculus
MAMVSEFLKQARFLENQEQEYVQAVKSYKGGPGSAVSPYPSFNVSSDVAALHKAIMVKGVDEATIIDILTKRTNAQRQQIKAAYLQENGKPLDEVLRKALTGHLEEVVLAMLKTPAQFDADELRGAMKGLGTDEDTLIEILTTRSNEQIREINRVYREELKRDLAKDITSDTSGDFRKALLALAKGDRCQDLSVNQDLADTDARALYEAGERRKGTDVNVFTTILTSRSFPHLRRVFQNYGKYSQHDMNKALDLELKGDIEKCLTTIVKCATSTPAFFAEKLYEAMKGAGTRHKALIRIMVSRSEIDMNEIKVFYQKKYGISLCQAILDETKGDYEKILVALCGGN

SEQ ID NO: 131 - protein, 46 aa, Macaca fascicularis
GLVTCEPGPFCHVQLCACDRKLVYCLKRNLWSYNPQYQYFPNILCS

SEQ ID NO: 132 - protein, 66 aa, Macaca fascicularis
LILAVIMIFGLLQAHGNLVDFRRMIKLKTGKEAALSYGFYGCHCGVGGKGAPKDATDRCCVVHDCC

SEQ ID NO: 133 - protein, 89 aa, Macaca fascicularis
FMLGLNLNTSYPLSPLSDFATQDSFDDDELDAAVADPDEFERIYEPLDVKSKKIHVVDSGLTFNLPYPLILRPQRGVDLIISFDFSARP

SEQ ID NO: 134 - protein, 25 aa, Homo sapiens
MIMALILMNLSEYMSLWMSKVKRFM

SEQ ID NO: 135 - protein, 329 aa, Rattus norvegicus
YFATGLQEEEKGAVHKRSFKVLEGLKKLNIQADQAPVIAVLGSGGGLRAHIACLGMLSAMKELGLLDAVTYLAGVSGSTWALSSFYTKNGNMQGMEEELKHRYEKNEWHFDESLDKAIQASRRENYSLTDFWAYLVVSRQTRELHDSNLSSFKKQVEEGVLPYPIFAAIDDDLHDDWREKKVQNSWFEFTPHHAGYPALRAYVPITEFGSRFENGKLVRPEPERDLTFLRGLWGSALADIKEDKAFIMDYFKDMYEKLKKKYLHRGGAKTVTYSNAEQMDVDEMFLDLLMAYAIDQDDPSIKDKLCDMQQALGPGTGEFGKEMAEIIHN

SEQ ID NO: 136 - protein, 1463 aa, Bos taurus; identical to SEQ ID NO: 11

SEQ ID NO: 137 - protein, 807 aa, Mus musculus
MQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGPGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKLITRKALLTLLKTVGADHHFPIIQGVSTEQGSAAATHPLFSLDRTQPPAISLNNLELQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 138 - protein, 806 aa, Homo sapiens; identical to SEQ ID NO: 22

SEQ ID NO: 139 - protein, 752 aa, Mus musculus; identical to SEQ ID NO: 44

SEQ ID NO: 140 - protein, 806 aa, Homo sapiens [sequence omitted]

SEQ ID NO: 141 - protein, 806 aa, Homo sapiens [sequence omitted]

SEQ ID NO: 142 - protein, 752 aa, Homo sapiens [sequence omitted]

SEQ ID NO: 143 - protein, 751 aa, Rattus norvegicus; identical to SEQ ID NO: 47

SEQ ID NO: 144 - protein, 1463 aa, Homo sapiens; identical to SEQ ID NO: 8

SEQ ID NO: 145 - protein, 752 aa, Homo sapiens; identical to SEQ ID NO: 61

SEQ ID NO: 146 - protein, 806 aa, Homo sapiens; identical to SEQ ID NO: 22

SEQ ID NO: 147 - protein, 1522 aa, Mus musculus
MAWSSRRVVASLASCSLVQSRGHGSDSRGCHLACLMVQWLAMLQLLWLQQLLLLGIHQGIAQDLTHIQEPSLEWRDKGIFIIQSESLKTCIQAGKSVLTLENCKQPNEHMLWKWVSDDHLFNVGGSGCLGLNISALEQPLKLYECDSTLISLRWHCDRKMIEGPLQYKVQVKSDNTVVARKQIHRWIAYTSSGGDICEHPSRDLYTLKGNAHGMPCVFPFQFKGHWHHDCIREGQKEHLLWCATTSRYEEDEKWGFCPDPTSMKVFCDATWQRNGSSRICYQFNLLSSLSWNQAHSSCLMQGGALLSIADEDEEDFIRKHLSKVVKEVWIGLNQLDEKAGWQWSDGTPLSYLNWSQEITPGPFVEHHCGTLEVVSAAWRSRDCESTLPYICKRDLNHTAQGILEKDSWKYHATHCDPDWTPFNRKCYKLKKDRKSWLGALHSCQSNDSVLMDVASLAEVEFLVSLLRDENASETWIGLSSNKIPVSFEWSSGSSVIFTNWYPLEPRILPNRRQLCVSAEESDGRWKVKDCKERLFYICKKAGQVPADEQSGCPAGWERHGRFCYKIDTVLRSFEEASSGYYCSPALLTITSRFEQAFITSLISSVAEKDSYFWIALQDQNNTGEYTWKTVGQREPVQYTYWNTRQPSNRGGCVVVRGGSSLGRWEVKDCSDFKAMSLCKTPVKIWEKTELEERWPFHPCYMDWESATGLASCFKVFHSEKVLMKRSWREAEAFCEEFGAHLASFAHIEEENFVNELLHSKFNWTQERQFWIGFNRRNPLNAGSWAWSDGSPVVSSFLDNAYFEEDAKNCAVYKANKTLLPSNCASKHEWICRIPRDVRPKFPDWYQYDAPWLFYQNAEYLFHTHPAEWATFEFVCGWLRSDFLTIYSAQEQEFIHSKIKGLTKYGVKWWIGLEEGGARDQIQWSNGSPVIFQNWDKGREERVDSQRKRCVFISSITGLWGTENCSVPLPSICKRVKIWVIEKEKPPTQPGTCPKGWLYFNYKCFLVTIPKDPRELKTWTGAQEFCVAKGGTLVSIKSELEQAFITMNLFGQTTNVWIGLQSTNHEKWVNGKPLVYSNWSPSDIINIPSYNTTEFQKHIPLCALMSSNPNFHFTGKWYFDDCGKEGYGFVCEKMQDTLEHHVNVSDTSAIPSTLEYGNRTYKIIRGNMTWYAAGKSCRMHRAELASIPDAFHQAFLTVLLSRLGHTHWIGLSTTDNGQTFDWSDGTKSPFTYWKDEESAFLGDCAFADTNGRWHSTACESFLQGAICHVVTETKAFEHPGLCSETSVPWIKFKGNCYSFSTVLDSRSFEDAHEFCKSEGSNLLAIRDAAENSFLLEELLAFGSSVQMVWLNAQFDNNNKTLRWFDGTPTEQSNWGLRKPDMDHLKPHPCVVLRIPEGIWHFTPCEDKKGFICKMEAGIPAVTAQPEKGLSHSIVPVTVTLTLIIALGIFMLCFWIYKQKSDIFQRLTGSRGSYYPTLNFSTAHLEENILISDLEKNTNDEEVRDAPATESKRGHKGRPICISP

SEQ ID NO: 148 - protein, 1522 aa, Mus musculus; identical to SEQ ID NO: 147

SEQ ID NO: 149 - protein, 390 aa, Mus musculus
MGAGQSVCFPPISGPHHIGCTDVMEGHSLEGSLFRLFYPCQASEKCEQPLWIPRYEYSMGLADYLQYNKRWVGLLFNVGIGSCRLPVSWNGPFKAKESGYPLIILSHGLGGFRASYSAFCMELASRGFVVAAVEHRDQSAAATYFCKPTSQESSPAESLEEEWLPFRRIKEGEKEFHVRNPQVHQRVKECVRVLRILQDASAGKTVVNVFPGGLDLMTLKGSVDTSRVAVMGHSFGGATAVLALTQEVQFRCAIALDAWMFPLERDFYPKARGPVFFINVEKFQTVESVNLMKKICAQHEQSRIVTVLGAVHRSQTDFAFVTGNLIAKFFSSNSRGTLDPYESQEVMVRAILAFLQKHLDLKEDYDQWSSFIEGVGPSLIQGAPHYLSSL

SEQ ID NO: 150 - protein, 390 aa, Rattus norvegicus
MGAGQSICFPPISGPHHIGCTDVMEGHSLEGSLFRLFYPCEASETCEQPLWIPRYEYCVGLADYLQYNKRWVGLLFNVGIGSCRLPVSWNGPFKTKESGYPLIILSHGLGGFRVSYSAFCMELASRGFVVAAIEHRDQSAAATYFCKQTSQESSPTESLEEEWIPFRRIKEGEKEFHVRNPQVHQRAKECVRVLQILQDASAGKPVINVFPGGLDLMTLKGSIDMSRVAVMGHSFGGATAILALTQEAQFRCAIALDAWMFPLEHDFYPKARGPVFFINVEKFQTVESVNLMKKICAQHEQSRIVTVLGAVHRSQTDFAFVTGNMIGKLFSSGTRGTLDPYEGQEVMVRAMLAFLQKHLDLKEDYDQWNSFIEGIGPSLIQGAPHYLSSL

SEQ ID NO: 151 - protein, 392 aa, Bos taurus [sequence omitted]

SEQ ID NO: 152 - protein, 436 aa, Cavia porcellus
MAPPKLHTLFCLSGFLALVHPFDWRDLDPVTYIQSSVWIQRIQSELLITSFGHTTIPKGNGPYSVGCTDLMSGYTNQSSFLRLYYPSQDNDFPDALWIPNEEYFQGLTETLGASSFLGKLLKLLYGSVKVPAKWNSPLKTGEKYPLIIFSHGLGAFRSIYSAIGIELASHGFIVAAVEHRDESAAATYYFQDAPAAESGNRSWIYYKVGNLETEERKRQLRQRGEECSQALSWLLSIDEGEPVKNVLDLNFDIQQLKGSLDRSKVAIIGHSFGGATVIQTLSEDQRFRCGIALDPWMFPVGEDVHSKIPQPLFFINSEYFQSANDTKKIEKFYQPQKERKMIAVKGSVHHNFVDFTFATGKIIGQMLSLKGKIDSEVAMDLINKASLAFLQKYLGLDKNFDQWNSLMEGDDENLIPEFTIPTTMQSSTGTEQRNPD

SEQ ID NO: 153 - protein, 752 aa, Equus caballus
MQFFGRLVNTLNSVSNLFSNPFRVKEVAVADYSSSSRVREEGQLILFQNTLHRTWDCVLVNPRNSKSGFRLFQLEVEADALVNFQQYSSLLPPFYESSSQVLHAEVLQQLSDLIRSHPSWSVAHLAVELGIRECFHHSRVISCANSVENEGGCTPLHLACRKGDGEILVELVQYCHAQMDVTDNSGETAFHYAVRGDNSQVLQLLGKNASAGLNQANNQGQTPLHLACQLGKQEMVRVLLLCNARCNIMGPGGCPIHTAMKFSQKGCAEMIISMDSNQIHSKDPHYGASPLHWAKNAEMARMLLKRGCDVNNTSSAGNTALHVAVMRNRFDCVMVLLTHGAHADARGEHGNTPLHLAMSKDNVEMVKALIVFGAEVDTPNDSGETPALLASKISKQLQDLMHISRARKPTFILSSMRDEKRTHDHLLCLDGGGVKGLVIIQLLIAIEKASGIATKDLFDWVAGTSTGGILALAILHSKSMAYMRCLYFRMKDEVFRGSRPYESGPLEEFLKREFGEHTKMTDVKKPKVMLTGTLSDRQPAELHLFRNYEAPECVREPRFSQNINLKPPTQPSDQLVWRAARSSGAAPTYFRPNGRFLDGGLLANNPTLDAMTEIHEYNQDLIRKGQDSKVKKLSVVVSLGTGRSPQVPVTCVDVSRPSNPWELPKTVLGAKELGKMVVDCCTDPDGRAVDRARAWCEMVGIQYFRLNPQLGTDIMLDEINDSVLVNALWETEVYIYEHREQFQKLIQLLLSP

SEQ ID NO: 154 - protein, 806 aa, Equus caballus
MQFFGRLVNTLNSVSNLFSNPFRVKEVAVADYSSSSRVREEGQLILFQNTLHRTWDCVLVNPRNSKSGFRLFQLEVEADALVNFQQYSSLLPPFYESSSQVLHAEVLQQLSDLIRSHPSWSVAHLAVELGIRECFHHSRVISCANSVENEGGCTPLHLACRKGDGEILVELVQYCHAQMDVTDNSGETAFHYAVRGDNSQVLQLLGKNASAGLNQANNQGQTPLHLACQLGKQEMVRVLLLCNARCNIMGPGGCPIHTAMKFSQKGCAEMIISMDSNQIHSKDPHYGASPLHWAKNAEMARMLLKRGCDVNNTSSAGNTALHVAVMRNRFDCVMVLLTHGAHADARGEHGNTPLHLAMSKDNVEMVKALIVFGAEVDTPNDSGETPALLASKISKLVTRKALLTLLRTVGADCQLPLVSVVPVQQGSAAAHHRVSLERSQPPPISLNNLELQDLMHISRARKPTFILSSMRDEKRTHDHLLCLDGGGVKGLVIIQLLIAIEKASGIATKDLFDWVAGTSTGGILALAILHSKSMAYMRCLYFRMKDEVFRGSRPYESGPLEEFLKREFGEHTKMTDVKKPKVMLTGTLSDRQPAELHLFRNYEAPECVREPRFSQNINLKPPTQPSDQLVWRAARSSGAAPTYFRPNGRFLDGGLLANNPTLDAMTEIHEYNQDLIRKGQDSKVKKLSVVVSLGTGRSPQVPVTCVDVSRPSNPWELPKTVLGAKELGKMVVDCCTDPDGRAVDRARAWCEMVGIQYFRLNPQLGTDIMLDEINDSVLVNALWETEVYIYEHREQFQKLIQLLLSP

SEQ ID NO: 155 - protein, 779 aa, Equus caballus
MSINLTVDIYIYLLSNARSLYGKQRSKQLHFLCSPEHYRSISHISLQRAFHTSKVRCKWTKSEAHSCSKHCYSPSDHGVHTGILKLSTSAPRGLTKVSIRMSRIKSTLNSVSKALFGKQNEMISCLAQFKPSSRILRKVSDSVWLKQKNVRQAIKSLKRYSDKSEEKSSFPEKKSHIIDKDKDIDKQSLFHYSTSITTKFGESFYFLSNHINSYFKREEKMSQKKENKHFQDNSELEDEKSSSPDSGVLTDEKQDSESSLHTVDKPSSPSGTPEVLPVSAKQSIANFLSRPTEGVQALVGGYIGGLVPKLKYNSKSQSEEQEEAGKAEQAVSKDKNAEEKKRLSLQREKIIARVSIDNRTRALVQALRRTTDPKLCINRVEELTFHLLEFPEGKGVAVKEKIIPCLLRLRQIKDETLQAAVREILALIGYVDPVKGRGIRILAIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSSLMIETARNPTCPKVAAVSTIVNRGITPKAFVFRNYGHFPGINSHYLGGCQYKMWQAIRASSAAPGYFEEYALGNDLHQDGGLLLNNPSALAMHECKCLWPDVPLECIVSLGTGRYESDVRNAVTYTSLKTKLSNVINSATDTEEVHIMLDGLLPPDTYFRFNPVMCENIPLDESRNEKLDQLQLEGLKYIERNEEKMKKLAKILSQEKTTLQKINDWIKLKTDMYEGLPFFSKL

SEQ ID NO: 156 - protein, 1471 aa, Ornithorhynchus anatinus
MLSGPLPALLLQLLQLLLQLLHRGPGGGCSLAGPPPVDEPASDLLGKGIFMIQSDYLRTCISSGKNGLVLQDCHQPTKNMLWKWVSKRHLFNLGSSGCLGLNISNEEQPLGLYECDSPHSSLWWHCNRKVVVGASQYALEIKNYNLVVARRQSSHGWVQYLSDGDDICEHPFQELYTIQGNSQGRPCVFPFRYNNQWFYECTKEGRKDGLLWCATTSQYEKDQTWGFCPNPGRYEIGCKVFWEKDPDTNICYQFNLNSFLSWNEARSSCKMQGGDLLSITHWKEENFIQKFLSVKEVKKVWIGLNQLDEVNGWQWSDGTPLIHLNWDPDVNFDPFVQYHCGTFNSLLWDSWQNHDCESPLPYVCKKHLNHTKRELLAEKNTWKYYPTHCEPSWHPYNGNCYRLQKEEKNWTAALHSCQSIKSKLINMASLAEVEFLVNLLKDENVSETWIGLSSGRNPVFFDWSGGSSATFTLWHKQQPNTFPNGSRLCVSADKTGGHWKVRNCEETLFYICKNAGKVLSEAKSGCQEGWERHGGFCYKIDLIRRSFDQASRGYYCPPSLVTVTNRFEQAFITNMISSVVKTEDSYFWIALQDQNVTGEYTWKVRGQEYQPVQYTNWNKYQPRYNGGCVVMRGGNPPGLWEVKDCQRFRAMSLCKQPLNPHPETQREKIWPFEPCFLGWESKPNLPSCYKVFHSEKVLMKRTWSEAEALCEDFGAHLASFSHIDEEDFVNEMVLSKFNRTEERQFWIGFNKRNPLSGGSWEWSDGTPVISSFLDDMYIGEDARNCAIYQTNKTVLPLRCGSKREWICKLPKDVRPMIPKWYQYDGPWLFHHGTEYLFHTSATEWANFELVCQLLDSNLLTIHSAEEQEFVQNKIKTLSKSDVNWWMGLHKMGPNDGFCWKDGSPLIFQNWDKGRERSGQNQRQRCGFISSETGLWGDDDCSVAMPSICKRKKIWITEKDLSEQPHGLCPKGWLYFGSKCFLVEIPKDPSKLKSWKSAQDSCAEEDGVLASIENEVEQAFITMNLFGQKANVWIGLQNSDYEEWLNGKHVAYSNWLPVDIINSQSLNTTKLREQVHLCALLSSNPNFHFTGKWYLEDCGKESYGYICEKMQDTSKHNTNASTMYPTSSTLQYGNRTFKVIGGNMTWYMALDICAANGAELVSITDQFRQSFLTVLVNQLGHAHWIGLFTSDNGLNFEWSDGTKSSFAYWEDESPSLGGCTLVDINGGWKSADCETLLQGAVCHVPTETSLSEFKGLCSETSFPWVKLKNNCYSFSTVLQSMSFDAAQKFCKGQGSNLLTIKEEVENSFLLEELHAYHSSVPMVWLNAQFDSNNGTITWFDGSPAELSNWGIREPDLDRFKTQLCIAMNTKDAVWQLCPCTEKKGFICKMETDANDLNIWAGKAPSHGFIPLAVTVTLIVILGFSTFSFCLYKLNSRLFRRFSAFRITYYTSTNSGIAPLEENILISDLERYD

SEQ ID NO: 157 - protein, 752 aa, Rattus norvegicus
MQFFGRLVNTLSSVTNLFSNPFRVKEVSLADYASSERVREEGQLILLQNASNRTWDCVLVSPRNPQSGFRLFQLESEADALVNFQQYSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACQMGKQEMVRVLLLCNARCNIMGPGGFPIHTAMKFSQKGCAEMIISMDSNQIHSKDPRYGASPLHWAKNAEMARMLLKRGCDVDSTSASGNTALHVAVTRNRFDCVMVLLTYGANAGARGEHGNTPLHLAMSKDNMEMVKALIVFGAEVDTPNDFGETPAFIASKISKQLQDLMPVSRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCTPNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 158 - protein, 752 aa, Rattus norvegicus; identical to SEQ ID NO: 157

SEQ ID NO: 159 - protein, 776 aa, Rattus norvegicus
MSINLTLDIYIYFLNNARSFCGKQRSKQLNFLCSKQYWRMNHVNVHREFHTSKKSCKWNRSEAHCSKHWHSSSNHGVHIGIVKLSTSAPKGLTKVSIHMSRIKSTLNSVSKAIFGSQNEMVSRLAQFKPSSRIFRKVSDRGWLKHKNVKQAIESLKNYSDKSAEKNSFAEQKSYFADKEEGSDKHSLYHYAYRITTRFGESFYFLANHINSYFKNKEKMSQIKEDRQLQDKPCLEESKSISPSPDILTDRPDSGPPLNVEDKLSSSTQLPEALPVSTKQSIANFLSRPTEGVQALVGGYIGGLVPKLKSDPKSQPEEEEEPSKTDEPICKDKKAEEKKRVLLQREKIIARVSIDNRTRALVQALRRTTDPKLCITRVEELTFHLLEFPEGKGVAVKEKIIPYLLRLRQIKDETLQAAVREILALIGYVDPVKGRGIRILAIDGGGTRGVVALQTLRKLVELTQKPIHQLFDYICGVSTGAILAFMLGLFHMPLDECEELYRKLGSDVFTQNVIVGTVKMSWSHAFYDSHTWEKILKDKVGSALMIETARDPLCPKVAAVSTIVNRGQTPKAFVFRNYGHFPGTNSHYLGGCQYKMWQAIRASSAAPGYFAEYALGNDLHQDGGLLLNNPSALALHECKCIWPDTPLECIVSLGTGRYESDVRNTTTYTSLKTKLSNVISSATDTEEVHIMLDGLLPADTYFRFNPVICENIPLDESRNEKLDQLQLEGMKYLERNDEKMKKLAKILSREKTTLQKISDWIKLKSDMYEGLPFFSKL

SEQ ID NO: 160 - protein, 1522 aa, Mus musculus
MAWSSRRVVASLASCSLVQSRGHGSDSRGCHLACLMVQWLAMLQLLWLQQLLLLGIHQGIAQDLTHIQEPSLEWRDKGIFIIQSESLKTCIQAGKSVLTLENCKQPNEHMLWKWVSDDHLFNVGGSGCLGLNISALEQPLKLYECDSTLISLRWHCDRKMIEGPLQYKVQVKSDNTVVARKQIHRWIAYTSSGGDICEHPSRDLYTLKGNAHGMPCVFPFQFKGHWHHDCIREGQKEHLLWCATTSRYEEDEKWGFCPDPTSMKVFCDATWQRNGSSRICYQFNLLSSLSWNQAHSSCLMQGGALLSIADEDEEDFIRKHLSKVVKEVWIGLNQLDEKAGWQWSDGTPLSYLNWSQEITPGPFVEHHCGTLEVVSAAWRSRDCESTLPYICKRDLNHTAQGILEKDSWKYHATHCDPDWTPFNRKCYKLKKDRKSWLGALHSCQSNDSVLMDVASLAEVEFLVSLLRDENASETWIGLSSNKIPVSFEWSSGSSVIFTNWYPLEPRILPNRRQLCVSAEESDGRWKVKDCKERLFYICKKAGQVPADEQSGCPAGWERHSRFCYKIDTVLRSFEEASSGYYCSPALLTITSRFEQAFITSLISSVAEKDSYFWIALQDQNNTGEYTWKTVGQREPVQYTYWNTRQPSNRGGCVVVRGGSSLGRWEVKDCSDFKAMSLCKTPVKIWEKTELEERWPFHPCYMDWESATGLASCFKVFHSEKVLMKRSWREAEAFCEEFGAHLASFAHIEEENFVNELLHSKFNWTQERQFWIGFNRRNPLNAGSWAWSDGSPVVSSFLDNAYFEEDAKNCAVYKANKTLLPSNCASKHEWICRIPRDVRPKFPDWYQYDAPWLFYQNAEYLFHTHPAEWATFEFVCGWLRSDFLTIYSAQEQEFIHSKIKGLTKYGVKWWIGLEEGGARDQIQWSNGSPVIFQNWDKGREERVDSQRKRCVFISSITGLWGTENCSVPLPSICKRVKIWVIEKEKPPTQPGTCPKGWLYFNYKCFLVTIPKDPRELKTWTGAQEFCVAKGGTLVSIKSELEQAFITMNLFGQTTNVWIGLQSTNHEKWVNGKPLVYSNWSPSDIINIPSYNTTEFQKHIPLCALMSSNPNFHFTGKWYFDDCGKEGYGFVCEKMQDTLEHHVNVSDTSAIPSTLEYGNRTYKIIRGNMTWYAAGKSCRMHRAELASIPDAFHQAFLTVLLSRLGHTHWIGLSTTDNGQTFDWSDGTKSPFTYWKDEESAFLGDCAFADTNGRWHSTACESFLQGAICHVVTETKAFEHPGLCSETSVPWIKFKGNCYSFSTVLDSRSFEDAHEFCKSEGSNLLAIRDAAENSFLLEELLAFGSSVQMVWLNAQFDNNNKTLRWFDGTPTEQSNWGLRKPDMDHLKPHPCVVLRIPEGIWHFTPCEDKKGFICKMEAGIPAVTAQPEKGLSHSIVPVTVTLTLIIALGIFMLCFWIYKQKSDIFQRLTGSRGSYYPTLNFSTAHLEENILISDLEKNTNDEEVRDAPATESKRGHKGRPICISP

SEQ ID NO: 161 - protein, 752 aa, Mus musculus; identical to SEQ ID NO: 44

SEQ ID NO: 162 - protein, 795 aa, Mus musculus
RPFPKPPGAPVLNVVTWTLLRTGLVSATLRHRGRLGLSAAPQRMQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGPGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKQLQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 163 - protein, 832 aa, Mus musculus
PGSWRLGACDPEQRGRLGLSAAPQRMQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGPGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKLITRKALLTLLKTVGADHHFPIIQGVSTEQGSAAATHPLFSLDRTQPPAISLNNLELQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 164 - protein, 777 aa, Mus musculus
PGSWRLGACDPEQRGRLGLSAAPQRMQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGPGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKQLQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 165 - protein, 775 aa, Monodelphis domestica
MSIHLTLDIYIYLLSNARSLCGKQRSKQLYLLCTSKYWRISYINQQRSFHISRTRYKWTRSHTFVSSKHSCNPRNHDLHIGVSKLSTSAPKGLTKVSIHMSRIKNTLDSVSKAVFGNQNEMFSRFSRFKPGILRKKSEDDVLKQKSVKQASGTNTLNDSSDNKTEKGPFPEEKGLEERKQNIYYTNYIIAKFEESLYFLSNHINSYFTNMTERTENDHLQQATEMKMGKDEAGIRESPSKDEVQLKEKGTDSQFLSPTVAHSEELTGTSDTLPVSVKQSFANFLARPSDSVQALVGGYIVGLVPKLKADAKYHSEEFQGGKAEQASGKENHEEEKKHLSLQREKIIERVSIDNRTRALVRALRRTTDHKLCINRIEELTFHLLAFPEARALAVKEKLVPYLLRLRRNKDEILQATVRENLALIGYTDPVKGRGIRILTIDGGGIRGVVALQSLRKIVELTKKPIHQLFDYICGVSTGAILAFMVGLFHMDLDDCEELYRKLGTDVFTQNLIIGTVKMGWKHEFYDSETWERILKDRLGSNLMIETARNPKCPKVAAVSTVVNRGIQPKAFVFRNYDLFPGSKSHYLGGCHHKVWQAIRASSAAPGYFAEYTLGKDLHQDGGLLLNNPTALAMHECKCLWPDTPLQCIVSLGTGRYEGDVRNYSMTATSLRSKLSTVISSATDTEEVHIMLDDFLPPDTYFRINPVMRENIPLDESRNEKLDFLQSESIKYLERNEEKIKKLTKILTQEKTALQKINDWLKLKSDMYEGFPFLSKL

SEQ ID NO: 166 - protein, 782 aa, Monodelphis domestica
MSIHLTLDIYIYLLSNARSLCGKQRSKQLYLLCTSKYWRISYINQQRSFHISRTRYKWTRSHTFVSSKHSCNPRNHDLHIGVSKLSTSAPKGLTKVSIHMSRIKNTLDSVSKAVFGNQNEMFSRFSRFKPGILRKKSEDDVLKQKSVKQASGTNTLNDSSDNKTEKGPFPEAKIDPVLEKGLEERKQNIYYTNYIIAKFEESLYFLSNHINSYFTNMTERTENDHLQQATEMKMGKDEAGIRESPSKDEVQLKEKGTDSQFLSPTVAHSEELTGTSDTLPVSVKQSFANFLARPSDSVQALVGGYIVGLVPKLKADAKYHSEEFQGGKAEQASGKENHEEEKKHLSLQREKIIERVSIDNRTRALVRALRRTTDHKLCINRIEELTFHLLAFPEARALAVKEKLVPYLLRLRRNKDEILQATVRENLALIGYTDPVKGRGIRILTIDGGGIRGVVALQSLRKIVELTKKPIHQLFDYICGVSTGAILAFMVGLFHMDLDDCEELYRKLGTDVFTQNLIIGTVKMGWKHEFYDSETWERILKDRLGSNLMIETARNPKCPKVAAVSTVVNRGIQPKAFVFRNYDLFPGSKSHYLGGCHHKVWQAIRASSAAPGYFAEYTLGKDLHQDGGLLLNNPTALAMHECKCLWPDTPLQCIVSLGTGRYEGDVRNYSMTATSLRSKLSTVISSATDTEEVHIMLDDFLPPDTYFRINPVMRENIPLDESRNEKLDFLQSESIKYLERNEEKIKKLTKILTQEKTALQKINDWLKLKSDMYEGFPFLSKL

SEQ ID NO: 167 - protein, 752 aa, Bos taurus
MQFFGRLVNTLSSVTNLFVNPFRVKEVAVEDYHSRRRVREEGQLILFQNSSNRTWDCILVNPRNAQSGFRLFQLETEADALVNFQQYSSQLPPFYESSTHILQAEVLQQLTDLIRSHPSWSVAHLAVELGIRECFHHSHIISCANNKENEEGCTPLHLACRKGDTEVLSELVQHCRANMDVTDNSGETAFHYAVQGDSSQVLQLLGKNASGGLNQVNNQGLTPLHLACQLGKQEMVRVLLLCNARCNIMGPGGYPIHTAMKFSQKGCAEMIVSMDSSQIHSKDPRYGASPLHWAKNAEMARLLLKRGCDVNGTSSAGNTALHVAVMRNRFDCVMVLLTHGANADARGEHGNTPLHLAMSKDNVEMIKALIVFGAEVDTPNDFGETPAFIASRISKQLQDITQISRARKPAFILSSMRDEKRTHDHLLCLDGGGVKGLVIIQLLIAIEKASGIATKDLFDWVAGTSTGGILALAILHSKSMAYMRGVYFRMKDEVFRGSRPYESGPLEEFLKREFGEHTKMTDVKKPKVMLTGTLSDRQPAELHLFRNYEAPECVREPRFSQNVNLKPPTHPSEQLVWRAARSSGAAPTYFRPNGRFLDGGLLANNPTLDAMTEIHEYNQDLIRKGQDSKVKKLSVVVSLGTGRSPQVPVTCVDVFRPSNPWELAKTVFGAKELGRMVVDCCTDPDGRAVDRARAWCEMVGIQYFRLNPQLGTDIMLDEINDTVLVNALWETEVYIYEHREQFQKLVQLLLSP

SEQ ID NO: 168 - protein, 805 aa, Bos taurus
MQFFGRLVNTLSSVTNLFVNPFRVKEVAVEDYHSRRRVREEGQLILFQNSSNRTWDCILVNPRNAQSGFRLFQLETEADALVNFQQYSSQLPPFYESSTHILQAEVLQQLTDLIRSHPSWSVAHLAVELGIRECFHHSHIISCANNKENEEGCTPLHLACRKGDTEVLSELVQHCRANMDVTDNSGETAFHYAVQGDSSQVLQLLGKNASGGLNQVNNQGLTPLHLACQLGKQEMVRVLLLCNARCNIMGPGGYPIHTAMKFSQKGCAEMIVSMDSSQIHSKDPRYGASPLHWAKNAEMARLLLKRGCDVNGTSSAGNTALHVAVMRNRFDCVMVLLTHGANADARGEHGNTPLHLAMSKDNVEMIKALIVFGAEVDTPNDFGETPAFIASRISKLVTRKALLTLLRTVGADYRFPLTQGFSTEQCSAAAPSFSMERSHPPPISLNNLELQDITQISRARKPAFILSSMRDEKRTHDHLLCLDGGGVKGLVIIQLLIAIEKASGIATKDLFDWVAGTSTGGILALAILHSKSMAYMRGVYFRMKDEVFRGSRPYESGPLEEFLKREFGEHTKMTDVKKPKVMLTGTLSDRQPAELHLFRNYEAPECVREPRFSQNVNLKPPTHPSEQLVWRAARSSGAAPTYFRPNGRFLDGGLLANNPTLDAMTEIHEYNQDLIRKGQDSKVKKLSVVVSLGTGRSPQVPVTCVDVFRPSNPWELAKTVFGAKELGRMVVDCCTDPDGRAVDRARAWCEMVGIQYFRLNPQLGTDIMLDEINDTVLVNALWETEVYIYEHREQFQKLVQLLLSP

SEQ ID NO: 169 - protein, 784 aa, Bos taurus
MSINLTIDLYYIYLLSNARSLCGKQRSKQLPFLCSPEHYWRISHISLQRGVHMSRIRCKWTKSEAHSCSKHCSPLSHHGLHLAVLRLSTSAPKGLTKVSPRMSRIKNTLNSVSKAVFGKQNEMISRLAQLKPSSRILRKVTDSGWLKQKSVKQTIKFLKKYSDKSAEKSSIPAKESQVIEKDDIGKPSLFHYTSNITTKFGESFYFLSSHINSYFKREEKMSQQNEDQHFQEKSELELKKVEDEKPSSPDPGILSDKKLDSEASLYSEDKPGSPSGTPEVLPISTKQSIANFLSRPTEGVQALVGGYIGGLVPKLKYDSKSQLEDQEEATKAEQAVSKDKNAEEKRRLSLQREKIIARVSIDNRTRALVQALRRTTDPRLCINRVEELTFHLLEFPEGKGVAVKEKIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSSLMIETARNPKCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNNVTYTSLKTKLSNVINSATDTEEVHVMLDGLLPPDTYFRFNPVMCENIPLDESRNEKLNQLQLEGLKYIERNEEKMKKLAKILSQEKTTLQKINDWIKLKTDMYEGLPFFSKL

SEQ ID NO: 170 - protein, 1463 aa, Homo sapiens; identical to SEQ ID NO: 8

SEQ ID NO: 171 - protein, 1463 aa, Homo sapiens; identical to SEQ ID NO: 8

SEQ ID NO: 172 - protein, 1324 aa, Homo sapiens; identical to SEQ ID NO: 79

SEQ ID NO: 173 - protein, 782 aa, Homo sapiens; identical to SEQ ID NO: 110

SEQ ID NO: 174 - protein, 782 aa, Homo sapiens; identical to SEQ ID NO: 110

SEQ ID NO: 175 - protein, 682 aa, Homo sapiens
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 176 - protein, 782 aa, Homo sapiens; identical to SEQ ID NO: 110

SEQ ID NO: 177 - protein, 806 aa, Homo sapiens; identical to SEQ ID NO: 22

SEQ ID NO: 178 - protein, 752 aa, Homo sapiens; identical to SEQ ID NO: 61

SEQ ID NO: 179 - protein, 752 aa, Mus musculus
MQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGLGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKQLQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 180 - protein, 752 aa, Mus musculus; identical to SEQ ID NO: 44

SEQ ID NO: 181 - protein, 782 aa, Pan troglodytes
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDEEEDIGKRSLFHYTSSITTKFGDSFYFLSNHINSYFKRKEKMSQQKENEHFRDKSELEDKKVEEGKLRSPDPDILAYKPGSESVHTVNKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 182 - protein, 782 aa, Pan troglodytes; identical to SEQ ID NO: 181

SEQ ID NO: 183 - protein, 682 aa, Pan troglodytes
MSRIKSTLNSVSKAVFGNQNEMISRLAQFKPSSQILRKVSDSGWLKQKNIKQAIKSLKKYSDKSAEKSPFPEEKSHIIDEEEDIGKRSLFHYTSSITTKFGDSFYFLSNHINSYFKRKEKMSQQKENEHFRDKSELEDKKVEEGKLRSPDPDILAYKPGSESVHTVNKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 184 - protein, 682 aa, Pan troglodytes; identical to SEQ ID NO: 183

SEQ ID NO: 185 - protein, 1327 aa, Pan troglodytes
MLLSPSLLLLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYFHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGALLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNAHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNNYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFDQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKKGSNLLTIKDEAENAFLLEELFAFGSSVQMVWLNAQFDGNSK

SEQ ID NO: 186 - protein, 1466 aa, Pan troglodytes
MLLSPSLLLLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYFHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGALLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNAHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNNYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFDQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKKGSNLLTIKDEAENAFLLEELFAFGSSVQMVWLNAQFDGNNETIKWFDGTPTDQSNWGIRKSDTDYFKPHHCVALRIPEGLWQLSPCQEKKGFICKMEADIRTAESLPEKGPSHSIIPLAVVLTLIVIVAICTLSFCIYKHNGGFFRRLAGFRNPYYPATNFSTVHLEENILISDLEKSDQ

SEQ ID NO: 187 - protein, 807 aa, Rattus norvegicus; identical to SEQ ID NO: 63

SEQ ID NO: 188 - protein, 806 aa, Homo sapiens; identical to SEQ ID NO: 22

SEQ ID NO: 189 - protein, 752 aa, Homo sapiens; identical to SEQ ID NO: 61

SEQ ID NO: 190 - protein, 1493 aa, Rattus norvegicus
  misc_feature (1462)..(1462): Xaa can be any naturally occurring amino acid
  misc_feature (1465)..(1465): Xaa can be any naturally occurring amino acid
  misc_feature (1486)..(1486): Xaa can be any naturally occurring amino acid
MAQWLAMLQLLWLQQLLLGVHQGSAQDLTHTQELALEWRDKGIFIIQSESLKTCIQAGKSVLTLENCTQPNEYMLWKWVSDNHLFNVGASGCLGLNISDLKRPLSLYECDSTLISLRWLCDRKTIVGPLQYKVQVNHSTVVAKKTPHKWSAYMPGGGDICEHLHRDIYTLKGNAHGMPCVFPFQFKGQWHHECIREGHKEHLLWCATTSRYEEDEKWGFCPDPTSTEIFCDAMWQRNDNSHICYQFNLLSSLSWNEAHSSCQMQGGALLSITDENEEAFIRKELSRVAKEVWTGLNQLDEMAGWQWSDGTPLSYLNWSQEVTAGPFVEYHCGTLKVASATWRSMDCESTLPYICKRHLNHTAEDILQKDSWKYHTTHCDPGWTPFNRKCYKLKKEKRTWQEALHSCQSDDSMLMDVTSLAEVELLVNLLGDENASETWIGLSSNKIPVSFAWSSGSSVIFTNWYLLEPRILPNRRQLCVSADQSDGRWKVKGCKETLPYICKKAGQVLEDEDSGCQAGWERHGKYCYKIDTVLRSFEQASGGYYCPPALLTITSRFEQAFITSLISSVARKDSYFWIALQDQNNTGEYTWKTMGQREPVQYTHWNAHQPSYHGGCVVLRGGSSFGRWEVKNCSDFKAMSLCKTPIKVWEKTEFEGRWPFHPCYMDWESETGLASCFKVFHSEKVLMKRSWREAEAFCEEFGAHLASFAHIEEENFVNKLLHSKFNWTQERQFWIGFNKRNPLNAGSWEWSDGSPVVSSFLDNAYFEEDAKNCAVYKANNTLLPSNCASKHEWICKIPRDVKPNFPVWYQYDAPWLFYQNAEYLFHTHPAEWATFEFVCGWLRSDFLTIYSAQEQEFIHSKIRALSKYGANWWIGLEDRRAGDQIHWSNGSPVIFQNWDKGRKGRMDSQRKRCVFMSAITGLWGTENCSVPMPSICKRVKIWVIEKEKPPTQHGTCPKGWLYFNYKCFLVTIPKDPRELKTWTGAQEFCAAKGGTLVSIESELEQAFITVNLFGQTTNVWIGLQSDNHENWVNGKPVVYSNWSPSDVINIPNYNTTEVQKRAPLCALMSSNPNFHFTGKWYFDDCGKKGYGFVCEKMQDTLENHVNVSDTYAVPSTLEYGNRTYKIIRANMTWYAAGKSCRMQGAELVSIPDVFHQSFLTVLLSRLGHAHWIGLSTPDNGLNFDWSDGTKSPFTYWKDEESASLGDCVFADTDGHWHGTACESHLQGAVCRVLTETKSFEHPVLCSETSVPWIRFKGHCYSFSTVLDSRSFEDAREFCKREGSNLLAIKDEAENLFLLEELLALGSSVQMVWLNAQLDNDNKTLRWFDGAATEQSNWGVRKPDMDHLKPHPCVVLRIPEGVWQSTPCEDKTGFICKVEAGIPAVTAHPEKGLSHSIMPVAAALALTIVLGILVLCLWIYKQNGGAILPRLTGSRGPYYPMSSFSMAHLEENILISDLEKNNQXRSXSCSNYGEQRRPRRASCLHFPXTSCPYNV

SEQ ID NO: 191 - protein, 1493 aa, Rattus norvegicus
  misc_feature (1462)..(1462): Xaa can be any naturally occurring amino acid
  misc_feature (1465)..(1465): Xaa can be any naturally occurring amino acid
  misc_feature (1486)..(1486): Xaa can be any naturally occurring amino acid
MAQWLAMLQLLWLQQLLLGVHQGSAQDLTHTQELALEWRDKGIFIIQSESLKTCIQAGKSVLTLENCTQPNEYMLWKWVSDNHLFNVGASGCLGLNISDLKRPLSLYECDSTLISLRWLCDRKTIVGPLQYKVQVNHSTVVAKKTPHKWSAYMPGGGDICEHLHRDIYTLKGNAHGMPCVFPFQFKGQWHHECIREGHKEHLLWCATTSRYEEDEKWGFCPDPTSTEIFCDAMWQRNDNSHICYQFNLLSSLSWNEAHSSCQMQGGALLSITDENEEAFIRKELSRVAKEVWTGLNQLDEMAGWQWSDGTPLSYLNWSQEVTAGPFVEYHCGTLKVASATWRSMDCESTLPYICKRHLNHTAEDILQKDSWKYHTTHCDPGWTPFNRKCYKLKKEKRTWQEALHSCQSDDSMLMDVTSLAEVELLVNLLGDENASETWIGLSSNKIPVSFAWSSGSSVIFTNWYLLEPRILPNRRQLCVSADQSDGRWKVKGCKETLPYICKKAGQVLEDEDSGCQAGWERHGKYCYKIDTVLRSFEQASGGYYCPPALLTITSRFEQAFITSLISSVARKDSYFWIALQDQNNTGEYTWKTMGQREPVQYTHWNAHQPSYHGGCVVLRGGSSFGRWEVKNCSDFKAMSLCKTPIKVWEKTEFEGRWPFHPCYMDWESETGLASCFKVFHSEKVLMKRSWREAEAFCEEFGAHLASFAHIEEENFVNKLLHSKFNWTQERQFWIGFNKRNPLNAGSWEWSDGSPVVSSFLDNAYFEEDAKNCAVYKANNTLLPSNCASKHEWICKIPRDVKPNFPVWYQYDAPWLFYQNAEYLFHTHPAEWATFEFVCGWLRSDFLTIYSAQEQEFIHSKIRALSKYGANWWIGLEDRRAGDQIHWSNGSPVIFQNWDKGRKGRMDSQRKRCVFMSAITGLWGTENCSVPMPSICKRVKIWVIEKEKPPTQHGTCPKGWLYFNYKCVCVCVPKDPRELKTWTGAQEFCAAKGGTLVSIESELEQAFITVNLFGQTTNVWIGLQSDNHENWVNGKPVVYSNWSPSDVINIPNYNTTEVQKRAPLCALMSSNPNFHFTGKWYFDDCGKKGYGFVCEKMQDTLENHVNVSDTYAVPSTLEYGNRTYKIIRANMTWYAAGKSCRMQGAELVSIPDVFHQSFLTVLLSRLGHAHWIGLSTPDNGLNFDWSDGTKSPFTYWKDEESASLGDCVFADTDGHWHGTACESHLQGAVCRVLTETKSFEHPVLCSETSVPWIRFKGHCYSFSTVLDSRSFEDAREFCKREGSNLLAIKDEAENLFLLEELLALGSSVQMVWLNAQLDNDNKTLRWFDGAATEQSNWGVRKPDMDHLKPHPCVVLRIPEGVWQSTPCEDKTGFICKVEAGIPAVTAHPEKGLSHSIMPVAAALALTIVLGILVLCLWIYKQNGGAILPRLTGSRGPYYPMSSFSMAHLEENILISDLEKNNQXRSXSCSNYGEQRRPRRASCLHFPXTSCPYNV

SEQ ID NO: 192 - protein, 620 aa, Macaca mulatta
MSRIKSTLNSVSKAIFGNRNEMISRLVQFKPSSQILRKVSDSGWLKQKNIKQAIKSLKKYSDKSAEKSPFPEEKSHIIDKEENRGKRSLFHYTNIITTKFGESFYFLSNHINSYFKRKEKMSQEKENEHFQDKSKLEDKEVEEGKLSSPDPGILAYKPGSESLDTVDKPTSPSAIPDVLPISTKQSIANLLSRPTEGVQALVGGYIGGLVPKLKYDSKSQSEEQEEPAKTDQAVSRDRNAEEKKRLSLQREKIIARVSIDNRTRALVQALRRTTDPKLCITRVEELTFHLLEFPEGKGVAVKERIIPYLLRLRQTKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQAWENILRDRMGSALMIETARNPTCPKVAADGGLLLNNPSALAMHECKCLWPDVPLECIVSLGTGRYESDVRNTVTHTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 193 - protein, 782 aa, Macaca mulatta
MSINLTVDIYIYLLSNARSVCGKQRSKQLHFLFSPKHCWRISHISLQRGFHTNIIRCKWTKSEAHSCSKHCYSPSNHGLHIGILKLSTSAPKGLTKVNICMSRIKSTLNSVSKAIFGNRNEMISRLVQFKPSSQILRKVSDSGWLKQKNIKQAIKSLKKYSDKSAEKSPFPEEKSHIIDKEENRGKRSLFHYTNIITTKFGESFYFLSNHINSYFKRKEKMSQEKENEHFQDKSKLEDKEVEEGKLSSPDPGILAYKPGSESLDTVDKPTSPSAIPDVLPISTKQSIANLLSRPTEGVQALVGGYIGGLVPKLKYDSKSQSEEQEEPAKTDQAVSRDRNAEEKKRLSLQREKIIARVSIDNRTRALVQALRRTTDPKLCITRVEELTFHLLEFPEGKGVAVKERIIPYLLRLRQTKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQAWENILRDRMGSALMIETARNPTCPKVAAVSTIVNRGITPKAFVFRNYGHFPGNNSHYLGGCQYKMWQAIRASSAAPGYFAEYALGNDLHQDGGLLLNNPSALAMHECKCLWPDVPLECIVSLGTGRYESDVRNTVTHTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 194 - protein, 782 aa, Macaca mulatta; identical to SEQ ID NO: 193

SEQ ID NO: 195 - protein, 782 aa, Macaca mulatta; identical to SEQ ID NO: 193

SEQ ID NO: 196 - protein, 682 aa, Macaca mulatta
MSRIKSTLNSVSKAIFGNRNEMISRLVQFKPSSQILRKVSDSGWLKQKNIKQAIKSLKKYSDKSAEKSPFPEEKSHIIDKEENRGKRSLFHYTNIITTKFGESFYFLSNHINSYFKRKEKMSQEKENEHFQDKSKLEDKEVEEGKLSSPDPGILAYKPGSESLDTVDKPTSPSAIPDVLPISTKQSIANLLSRPTEGVQALVGGYIGGLVPKLKYDSKSQSEEQEEPAKTDQAVSRDRNAEEKKRLSLQREKIIARVSIDNRTRALVQALRRTTDPKLCITRVEELTFHLLEFPEGKGVAVKERIIPYLLRLRQTKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQAWENILRDRMGSALMIETARNPTCPKVAAVSTIVNRGITPKAFVFRNYGHFPGNNSHYLGGCQYKMWQAIRASSAAPGYFAEYALGNDLHQDGGLLLNNPSALAMHECKCLWPDVPLECIVSLGTGRYESDVRNTVTHTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 197 - protein, 682 aa, Macaca mulatta; identical to SEQ ID NO: 196

SEQ ID NO: 198 - protein, 666 aa, Oryctolagus cuniculus; identical to SEQ ID NO: 118
  misc_feature (278)..(278): Xaa can be any naturally occurring amino acid

SEQ ID NO: 199 - protein, 786 aa, Oryctolagus cuniculus; identical to SEQ ID NO: 54

SEQ ID NO: 200 - protein, 1499 aa, Canis familiaris
MRAESQEGQAHFSTVLWDCSFKYNAHAASIRNSLLIGLESRIKNPDFLHHSAMNRTRFSGLQHPFLLQSNLNKGMFLIQSESLKKCIQAGKSVLTLENCKPPNKHMLWKWVSNHHLFNIGGSGCLGLNLSNPEQPLSIYECDSTHVSLRWHCNKNMIIGPLQYTVQVNDNNMLVASWKYLHKWISYLSDGGSICEYLHKDMYTIKGNAHGMPCMFPFQYNRQWHHECTQEGREDDLLWCATTSRYERDEKWGFCPDPTSTEVGCDAVWEKDLNSHICYQFNLLSSLSWSEAHSSCQMQGGALLSIADENEENFIRKHLGSEAVEMWMGLNQLDENAGWQWSDRTPLNYLNWNPEINFEPFVEYHCGTFNSFLPSAWRSRDCESTLPYICKKYLNNTDQEVIEKDAWKYYTTHCEPGWNPHSHNCYKLQKEKRTWNEALHSCQSDNSTLINIASLADVEFFVTLLGDENASETWIGLSSNKIPVSFEWSNGSSVTFTNWHTLEPQIFPNGSQQCVSAEQSEGRWKVKNCEETLFYICKKAGHVLSDTESGCQKGWERHGGFCYKIDTVLRTFDHASSGYHCPPALVTITNRFEQAFITSLISSVVKTKNSYFWIALQDQNDTGEYTWKTAWGQKSEPVQYTHWNARQPRYSGGCVVMRGRSPPGRWEVKDCRHFKAMSLCKQPVGKQEKTEQEERWPFHPCYLDWESEPGLASCFKVFHSEKVLMKRTWREAEAFCEEFGAHLASFAHIEEENFVNELLHSKFNRTEERQFWIGFNKRNPLNAGSWEWSDGTPVVSSFLDNTYFGEDARNCAVYKANKTLLPLHCSSKREWICKIPRDVRPKIPPWYQYDAPWLFYQDAEYLFHTYAAEWPSFEFVCVWLRGDILTIHSAHEQEFIHSKIRALSKYGVNWWIGLREERANDEFRWNDGAPVIYQNWDKRREGSMSNQSQRCGFISSITGLWASEECSVSLPGICKRKKIWVIEKEKDTPKQHGTCPKGWLYFNYKCLLMKIPKDPSDWKNWTSAQDFCVEEGGTLVAIENEVEQAFITMNLFGQTTNVWIGLQNDNYEKWLNGKPLAYSNWSPFDVINIPSHNTTEVQKHIPLCALLSSNPNFHFTGKWYFEDCGKEGHGFVCEKMQDTSGHTVNTSDMYPVPDTLEYGNRTYKIINANMTWYTAIKTCLMHGAELASITDQYHQSFLTVILNRLGHAHWIGLFTADNGLNFDWSDGTKSSFTFWKDDESSILGDCVFADTSGRWSSTACESFLQGAICHVPSETKQFGHPELCSETSIPWIKFKSNCYSFSTVLDSMSFEAAHEFCKKEGSNLLTIKDEDENSFLLEELSAFGSSVQMIWLNAQFDGDSKTIKWFDGTPTDQSNWGIRKPEMDHVKPHLCIALRISEGVWQLSPCQEKKGFICKMEAGLHAVKEHSGKGPSHSMVPLAVALTLIVILALSTLSFCIYKHNRGIFSRLAPFGNPYYPTNNFSTVHLEENILISDLEKNDP

SEQ ID NO: 201 - protein, 785 aa, Canis familiaris
MSINLTIDIYYIYLLSNARSLCGKQRSKQLHFLCSPKHYWRISHLSLQRGFHGSKTRCKLTKSEAHSCSNHCHSPSTHGLHIGILKLSTSTPKGLTKVSIRMSRIKSTLNSVSKAVFGTQNEMISRLAQFKPSSRILRKVSDSGWLKQKSIKQAIKSLKKYSDKSVENNSFSGKQSYILGKDEDIGKQSLFRYTSSITTRFGESFYFLSNHINSYFKREARMSKKKENKHFQEKSELEDKKVEEEKASSPDPGILIDKLDSESSVYSVDKPASTSGTPEALPVSTKQSIANFLSRPTEGVQALVGGYIGGLVPKLKYDSKSQPEEQEEVIKAEQPVSKDKNVEEKKRLSLQREKIIARVSIDNRTRALVQALRRTTDPKLCINRVEELTFHLLEFPEGKGVAVKYNTYAVIGIKLRQIKDETLQAAVREALALIGYVDPVKGRGIRILTIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSSLMIETARNPSCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNSVTSTSLKTKLSNVINSATDTEEVHVMLDGLLPPDTYFRFNPVMCENIPLDESRNEKLNQLQLEGLKYIERNEEKMKKLAKILSQEKTTLQKINDWIKLKTDMYEGLPFFSKL

SEQ ID NO: 202 - protein, 722 aa, Canis familiaris
MSINLTIDIYYIYLLSNARSLCGKQRSKQLHFLCSPKHYWRISHLSLQRGFHGSKTRCKLTKSEAHSCSNHCHSPSTHGLHIGILKLSTSTPKGLTKVSIRMSRIKSTLNSVSKAVFGTQNEMISRLAQFKPSSRILRKVSDSGWLKQKSIKQAIKSLKKYSDKSVENNSFSGKQSYILGKDEDIGKQSLFRYTSSITTRFGESFYFLSNHINSYFKREARMSKKKENKHFQEKSELEDKKVEEEKASSPDPGILIDKLDSESSVYSVDKPASTSGTPEALPVSTKQSIANFLSRPTEGVQALVGGYIGGLVPKLKYDSKSQPEEQEEVIKAEQPVSKDKNVEEKKRLSLQREKIIARVSIDNRTRALVQALRRTTDPKLCINRVEELTFHLLEFPEGKGVAVKEKIIPYLLRLRQIKDETLQAAVREALALIGYVDPVKGRGIRILTIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSSLMIETARNPSCPKVAADGGLLLNNPSALAMHECKCLWPDVPLECIVSLGTGRYESDVRNSVTSTSLKTKLSNVINSATDTEEVHVMLDGLLPPDTYFRFNPVMCENIPLDESRNEKLNQLQLEGLKYIERNEEKMKKLAKILSQEKTTLQKINDWIKLKTDMYEGLPFFSKL

SEQ ID NO: 203 - protein, 784 aa, Canis familiaris
MSINLTIDIYYIYLLSNARSLCGKQRSKQLHFLCSPKHYWRISHLSLQRGFHGSKTRCKLTKSEAHSCSNHCHSPSTHGLHIGILKLSTSTPKGLTKVSIRMSRIKSTLNSVSKAVFGTQNEMISRLAQFKPSSRILRKVSDSGWLKQKSIKQAIKSLKKYSDKSVENNSFSGKQSYILGKDEDIGKQSLFRYTSSITTRFGESFYFLSNHINSYFKREARMSKKKENKHFQEKSELEDKKVEEEKASSPDPGILIDKLDSESSVYSVDKPASTSGTPEALPVSTKQSIANFLSRPTEGVQALVGGYIGGLVPKLKYDSKSQPEEQEEVIKAEQPVSKDKNVEEKKRLSLQREKIIARVSIDNRTRALVQALRRTTDPKLCINRVEELTFHLLEFPEGKGVAVKEKIIPYLLRLRQIKDETLQAAVREALALIGYVDPVKGRGIRILTIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSSLMIETARNPSCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNSVTSTSLKTKLSNVINSATDTEEVHVMLDGLLPPDTYFRFNPVMCENIPLDESRNEKLNQLQLEGLKYIERNEEKMKKLAKILSQEKTTLQKINDWIKLKTDMYEGLPFFSKL

SEQ ID NO: 204 - protein, 683 aa, Canis familiaris
MSRIKSTLNSVSKAVFGTQNEMISRLAQFKPSSRILRKVSDSGWLKQKSIKQAIKSLKKYSDKSVENNSFSGKQSYILGKDEDIGKQSLFRYTSSITTRFGESFYFLSNHINSYFKREARMSKKKENKHFQEKSELEDKKVEEEKASSPDPGILIDKLDSESSVYSVDKPASTSGTPEALPVSTKQSIANFLSRPTEGVQALVGGYIGGLVPKLKYDSKSQPEEQEEVIKAEQPVSKDKNVEEKKRLSLQREKIIARVSIDNRTRALVQALRRTTDPKLCINRVEELTFHLLEFPEGKGVAVKEKIIPYLLRLRQIKDETLQAAVREALALIGYVDPVKGRGIRILTIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSSLMIETARNPSCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNSVTSTSLKTKLSNVINSATDTEEVHVMLDGLLPPDTYFRFNPVMCENIPLDESRNEKLNQLQLEGLKYIERNEEKMKKLAKILSQEKTTLQKINDWIKLKTDMYEGLPFFSKL

SEQ ID NO: 205 - protein, 806 aa, Canis familiaris
MQFFGRLVNTLSSVTNLFSNPFRVKEVAVADYTSSARVRDEGQLILFQNIPNRTWDCILVNPRNSQSGFRLFQLETEADALVNFQQYSSQLPPFYESSKHVLHTEVLQQLTDLIRSHPSWSAAHLAVELGIRECFHHSRIISCANNRENEEGCTPLHLACRKGDGEILVELVQYCHAQMDVTDNNGETAFHYAVQGDNSQVLQLLGKNASAGLNRVNNQGQTPLHLACQMGKQEMVRVLLLCNARCNIMGPTGYPIHTAMKFCHKGCAEMIISMDSNQIHSKDPRYGASPLHWAKNAEMARMLLKRGCDVNSTSCVGNTALHVAVMRNRFDCVMVLLTYGANADARGEHGNTPLHLAMSKDNVEMIKALIVFGAEVDTPNDFGETPASIASKISKLVTRKTLLTLLRTVGADYRLPLTHGAPSEQCSTTTHQSSSLERSQPPPISLNNLELQDIVQISRSRKPAFILSSMRDEKRTHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYEAPESVREPRFSQNINLKPPTQPSDQLVWRAARSSGAAPTYFRPNGRFLDGGLLANNPTLDAMTEIHEYNQDLIRKGQGNKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREQFQKLIQLLLSP

SEQ ID NO: 206 - protein, 836 aa, Canis familiaris
MGDHARLTRDSIFFQTEGAGGGASSPAPQKMQFFGRLVNTLSSVTNLFSNPFRVKEVAVADYTSSARVRDEGQLILFQNIPNRTWDCILVNPRNSQSGFRLFQLETEADALVNFQQYSSQLPPFYESSKHVLHTEVLQQLTDLIRSHPSWSAAHLAVELGIRECFHHSRIISCANNRENEEGCTPLHLACRKGDGEILVELVQYCHAQMDVTDNNGETAFHYAVQGDNSQVLQLLGKNASAGLNRVNNQGQTPLHLACQMGKQEMVRVLLLCNARCNIMGPTGYPIHTAMKFCHKGCAEMIISMDSNQIHSKDPRYGASPLHWAKNAEMARMLLKRGCDVNSTSCVGNTALHVAVMRNRFDCVMVLLTYGANADARGEHGNTPLHLAMSKDNVEMIKALIVFGAEVDTPNDFGETPASIASKISKLVTRKTLLTLLRTVGADYRLPLTHGAPSEQCSTTTHQSSSLERSQPPPISLNNLELQDIVQISRSRKPAFILSSMRDEKRTHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTGTLSDRQPAELHLFRNYEAPESVREPRFSQNINLKPPTQPSDQLVWRAARSSGAAPTYFRPNGRFLDGGLLANNPTLDAMTEIHEYNQDLIRKGQGNKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREQFQKLIQLLLSP

SEQ ID NO: 207 - protein, 782 aa, Homo sapiens; identical to SEQ ID NO: 110

SEQ ID NO: 208 - protein, 810 aa, Homo sapiens
MQAGWSGRHCRERASRRCSPSDCGLHPDCLLLQGLHDYLKFNNNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 209 - protein, 380 aa, Homo sapiens
ERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 210 - protein, 806 aa, Homo sapiens; identical to SEQ ID NO: 22

SEQ ID NO: 211 - protein, 782 aa, Homo sapiens; identical to SEQ ID NO: 110

SEQ ID NO: 212 - protein, 782 aa, Homo sapiens; identical to SEQ ID NO: 110

SEQ ID NO: 213 - protein, 1458 aa, Oryctolagus cuniculus; identical to SEQ ID NO: 13

SEQ ID NO: 214 - protein, 412 aa, Mus musculus; identical to SEQ ID NO: 116

SEQ ID NO: 215 - protein, 485 aa, Mus musculus
MIMLLMVGMLMAPCVGAHALDTPNPQELPPGLSKNINITFFNGVFKNVESVAEIFDCLGSHFTWLQAVFTNFPLLLQFVNSMRCVTGLCPRDFEDYGCACRFEMEGMPVDESDICCFQHRRCYEEAVEMDCLQDPAKLSADVDCTNKQITCESEDPCERLLCTCDKAAVECLAQSGINSSLNFLDASFCLPQTPETTSGKAATLLPRGIPEKPTDTSQIALSGEVAGEVRADTLTTLSRTKSVQDLQDTQASRTTSSPGSAEIIALAKGTTHSAGIKPLRLGVSSVDNGSQEAAGKACDRLAFVHLGDGDSMTAMLQLGEMLFCLTSHCPEEFETYGCYCGREGRGEPRDTLDRCCLSHHCCLEQMRQVGCLHGRRSQSSVVCEDHMAKCVGQSLCEKLLCACDQMAAECMASAFFNQSLKSPDGAECQGEPVSCEDGMLQGTLASSVDSSSEENSEEAPPQMERLRRFLEKPPGPLGARPLGGK

SEQ ID NO: 216 - protein, 346 aa, Homo sapiens; identical to SEQ ID NO: 96

SEQ ID NO: 217 - protein, 195 aa, Oryctolagus cuniculus; identical to SEQ ID NO: 89

SEQ ID NO: 218 - protein, 465 aa, Oryctolagus cuniculus
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKDKVSLCHLGWSAMAPSGLTAAPTSLGSSDPPTSASQVAGTTGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 219 - protein, 229 aa, Mus musculus
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGLLPRGEKPNPLRQKNAKVNQLLKVSLPKLANVQLLDIDGGFVHSDGAISCHDMFDFLHLTGGGYAKICKPLHELIMQLLEETPEEKQTTIA

SEQ ID NO: 220 - protein, 589 aa, Rattus norvegicus
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSSAITSPKGSLPPAALESSDSTNTTIEDEDAKAPRISDILNSVRRGCGTPEAEGPLSVGPPPCLSPGLLGPLPTPSPRISDILNSVRRGSGTPEAEGLPPVGPPPCPSPTLPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 221 - protein, 503 aa, Rattus norvegicus
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSSAITSPKGSLPPAALESSDSTNTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 222 - protein, 542 aa, Rattus norvegicus
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSSAITSPKGSLPPAALEPQTTVIHNPVDGIKESSDSTNTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 223 - protein, 347 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGEQQHNGPDALRS

SEQ ID NO: 224 - protein, 232 aa, Mus musculus
MSGEGENPASKPTPVQDVQGDGRWMSLHHRFVADSKDKEPEVVFIGDSLVQLMHQCEIWRELFSPLHALNFGIGGDSTQHVLWRLENGELEHIRPKIVVVWVGTNNHSHTAEQVTGGIKAIVQLVNKLQPQARVVVLGLLPRGQHPNPLREKNRQVNELVRAALAGYPRAHFLDADPGFVHSDGTISHHDMYDYLHLSRLGYTPVCRALHSLLLRLLAQDQGQGIPLPETAS

SEQ ID NO: 225 - protein, 231 aa, Pongo abelii
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLVNERQPQARVVVLDLLPRGQHPNPLREKNQRVNELVRAALAGHPRAHFLDADPGFVHSDGTISHHDMYDYLHLSRLGYAPVCRALHSLLLRLLAQDQGQGAPLLDPAP

SEQ ID NO: 226 - protein, 229 aa, Pongo abelii
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGLLPRGEKPNPLRQKNAKVNQLLKVSLPKLANVQLLDTDGGFVHSDGAISCHDMFDFLHLTGGGYAKICKPLHELIMQLLEETPEEKQTTIA

SEQ ID NO: 227 - protein, 229 aa, Homo sapiens; identical to SEQ ID NO: 226

SEQ ID NO: 228 - protein, 231 aa, Homo sapiens
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLVNERQPQARVVVLGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 229 - protein, 229 aa, Bos taurus; identical to SEQ ID NO: 226

SEQ ID NO: 230 - protein, 232 aa, Rattus norvegicus
MSGEGENPASKPTPVQDVQGDGRWMSLHHRFVADSKDKEPEVVFIGDSLVQLMHQCEIWRELFSPLHALNFGIGGDSTQHVLWRLENGELEHIRPKIVVVWVGTNNHSHTAEQVTGGIKAIVQLVNKLQPQARVVVLGLLPRGQHPNPLREKNRQVNELVRAALAGYPRAHFLDADPGFVHSDGTISHHDMYDYLHLSRLGYTPVCRALHSLLLRLLAQDQGQGIPLPETAP

SEQ ID NO: 231 - protein, 229 aa, Rattus norvegicus; identical to SEQ ID NO: 219

SEQ ID NO: 232 - protein, 232 aa, Bos taurus
MSGDENPASKPTPVQDVQGDGRWMSLHHRFVADSKDKEPEVVFIGDSLVQLMHQCEIWRELFSPLHALNFGIGGDSTQHVLWRLENGELEHIRPKIVVVWVGTNNHGHTAEQVTGGIKAIVQLVNERQPQARVVVLGLLPRGQHPNPLREKNRRVNELVRAALAGHPRAHFLDADPGFVHSDGTISHHDMYDYLHLSRLGYTPVCRALHSLLLRLLTQDQGQGGAPLPEPSP

SEQ ID NO: 233 - protein, 224 aa, Rattus norvegicus; identical to SEQ ID NO: 101

SEQ ID NO: 234 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 235 - protein, 384 aa, Mus musculus
MAQAARLSWVLVSSRCALTEGLLTRPWQPLSAQSRAGFTRVAAGSRGAAVRKGSPRLLGAAALALGGALGLYHTVRWHQRSQDLRAERSAAQLPLSNSLQLTLYQYKTCPFCSKVRAFLDFHSLPYQVVEVNPVRRTEIKFSSYRKVPILVAQEGDSLQQLNDSSVIISALKTYLVSGQPLEEVITYYPPMKAMNDQGKEVTEFCNKYWPMLDEKEAQQMYGGKEARTEEMKWRQWADDWLVHLISPNVYRTPAEALASFDYIVREGKFGAVEAAMAKYVGAAAMYLISKRLKSRHHLQDDVRVDLYEAANKWVTAVGKDRPFMGGQKPNLADLAVYGVLRVMEGLEAFDDLMRHSHIQPWYLRMERAIEEAPSVHHVNPSCKD

SEQ ID NO: 236 - protein, 195 aa, Mus musculus
MKLLCGFFLLWLGLVGNLAQSDPSPKEEESYSDWGLRQLRGSFESVNSYVDSFMELLGGKNGVCQYRCRYGKAPMPRPGYKAQEPNGCSSYFLGIKVPGSMDLGIPAMTKCCNQLDVCYDTCGANKYRCDAKFRWCLHSICSDLKRTLGFVSNVEAACDSLADTVFNTVWTLGCRPFMNSQRAACICAEEEKEEL

SEQ ID NO: 237 - protein, 504 aa, Homo sapiens; identical to SEQ ID NO: 84

SEQ ID NO: 238 - protein, 248 aa, Rattus norvegicus
MSLCSLAFTLFLTVVAGIKCNVTDVCAGSPGIPGAPGNHGLPGRDGRDGVKGDPGPPGPMGPPGGMPGLPGRDGLPGGPGAPGGRGDKGEPGERGLPGFPAYLDEELQTELYEIKHQILQTMGVLSLQGSMLSVGDKVFSTNGQSVNFDTIKEMCTRAGGNIAVPRTPEENEAIASIAKKYNNYVYLGMIEDQTPGDFHYLDGASVNYTNWYPGEPRGQGKEKCVEMYTDGTWNDRGCLQYRLAVCEF

SEQ ID NO: 239 - protein, 253 aa, Homo sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 240 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 241 - protein, 224 aa, Homo sapiens; identical to SEQ ID NO: 71

SEQ ID NO: 242 - protein, 320 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 243 - protein, 1365 aa, Pongo abelii
MLLSPSLLLPLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCDRKMITGPLQYSVQVAHDNTVVASRKYFHKWISYGSGGGDICEYLHKDLHTIKGNAHGMPCMFPFQYNHQWHHECTREGREDDLLWCATTSRYERDEKWGFCPDPTSAEVGCDTIWEKDLNSHICYQFNLLSSLSWSEAHSSCQMQGGALLSITDETEENFIREHMSSKTVEVWMGLNQLDEHAGWQWSDGTPLNYLNWSPEVNFEPFVEDHCGTFSSFIPSAWRSRDCASTLPYVCKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPQIFPNRSQLCVSAEQSEGHWKVKNCEETLFYVCKKAGHVLSDAESGCQEGWERHGGFCYKIDTVLRSFDQASSGYYCPPALVTITNRFEQAFITSLIGSVVKMKDSYFWIALQDQNDTGEYTWKPAGQKPEPVQYTHWNAHQPRYSGGCVAMRGRHPPGRWEVKHCRHFKAMSLCKQPVENQEKAEYEERWPFHPCYLDWESEPGLASCFKVFHSEKVLMKRTWREAEAFCEEFGAHLASFAHIEEENFVNELLYSKFNWTEERQFWIGFNKRNPLNAGSWEWSDRIPVVSSFLDNNYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERPVNNQSQRCGFISSITGLWGSEECSVSMPSICKRKKVLLIEKKKDTPKQHGTCPKGWLYFNYKCLLLNIPKDPNSWKNWMHAQHFCAEEGGTLVAIESEVEQAFITMNLFGQTTNVWIGLQNDDYETWLNGKPVVYSNWSPFDIINIPSHNTTDVQKHIPLCALLSSNPNFHFTGKWYFEDCGKEGYGFVCEKMQDTSGHGVNTSDMYPMPNTLEYGNRTYKIINANMTWYAAIKTCLMHGTQLVSITDQYHQSFLTVVLNRLGYAHWIGLFTTDNGLNFDWSDGTKSSFTFWKDEESSLLGDCVFADTNGLWHSTACESFLQGAICHVPPETRQSEHPELCSETSIPWIKFKSNCYSFSTVLDRMSFEAAHEFCKKEGSNLLTIKDEAENAFLLEELFAFGSSVQMVWLNAQFDGNNETIKWFDGTPTDQSNWGIRKPDTDYFKPHHCVALRIPEGL

SEQ ID NO: 244 - protein, 481 aa, Homo sapiens
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 245 - protein, 473 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 246 - protein, 471 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGENEDEKLNEVMQEAWKYNRECKLLRDTLQSFSWNGRGFTDKVDRLKLAEIVKQVIEEQTTSHESQ

SEQ ID NO: 247 - protein, 230 aa, Rattus norvegicus
MCGNNMSAPMPAVVPAARKATAAVIFLHGLGDTGHGWAEAFAGIKSSHIKYICPHAPVMPVTLNMSMMMPSWFDIIGLSPDSQEDESGIKQAAETVKALIDQEVKNGIPSNRIILGGFSQGGALSLYTALTTQQKLAGVTALSCWLPLRASFSQGPINSANRDISVLQCHGDCDPLVPLMFGSLTVERLKGLVNPANVTFKVYEGMMHSSCQQEMMDVKYFIDKLLPPID

SEQ ID NO: 248 - protein, 670 aa, Rattus norvegicus
MPSYTVTVATGSQWFAGTDDYIYLSLIGSAGCSEKHLLDKAFYNDFERGGRDSYDVTVDEELGEIYLVKIEKRKYRLHDDWYLKYITLKTPHDYIEFPCYRWITGEGEIVLRDGCAKLARDDQIHILKQHRRKELETRQKQYRWMEWNPGFPLSIDAKCHKDLPRDIQFDSEKGVDFVLNYSKAMENLFINRFMHMFQSSWHDFADFEKIFVKISNTISERVKNHWQEDLMFGYQFLNGCNPVLIKRCTELPKKLPVTTEMVECSLERQLSLEQEVQEGNIFIVDYELLDGIDANKTDPCTHQFLAAPICLLYKNLANKIVPIAIQLNQTPGEKNPIFLPTDSKYDWLLAKIWVRSSDFHIHQTITHLLRTHLVSEVFGIAMYRQLPAVHPLFKLLVAHVRFTIAINTKAREQLNCEYGLFDKANATGGGGHVQMVQRAVQDLTYSSLCFPEAIKARGMDNTEDIPYYFYRDDGLLVWEAIQSFTTEVVSIYYEDDQVVEEDQELQDFVKDVYVYGMRGRKASGFPKSIKSREKLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMIRFRKNLEAIVSVIAERNKNKKLPYYYLSPDRFQTV

SEQ ID NO: 249 - protein, 481 aa, Homo sapiens; identical to SEQ ID NO: 244

SEQ ID NO: 250 - protein, 230 aa, Rattus norvegicus; identical to SEQ ID NO: 247

SEQ ID NO: 251 - protein, 266 aa, Macaca fascicularis
MSWSHAFYDSQAWENILRDRMGSALMIETARNPTCPKVAAVSTIVNRGITPKAFVFRNYGHFPGNNSHYLGGCQYKMWQAIRASSAAPGYFAEYALGNDLHQDGGLLLNNPSALAMHECKCLWPDVPLECIVSLGTGRYESDVRNTVTHTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSNCDEYMHMAS

SEQ ID NO: 252 - protein, 803 aa, Mus musculus
MSINLTLDIYIYFLNNARSLCGKQRSKQLHFVCSKQYWRMNHVNVHREFHTSKKSCKWNRSEAHCSKHWHSPSNHGLHFGIVRLSTSAPKGLTKVSIHMSRIKSTLNSVSKAIFGSQNEMVTRLAQFKPSSRILRKVSDKGWLKQKNVKQAVESLKNYSDKSAGKNSLAEQKSYFADKEEDSGKHSLFHYTYGITTRFGESFSVLANHINSYFKSKGKMSQTKEDKQLQDKPDLEERKSSSPGPDTVADRPDSESPLEVKDKLSSPTQMPEAHPVSAKQSIANFLSRPTEGVQALVGGYIGGLVPKLKSDPKSPPEEQEVSAKTEQAVNKDKKAEEKKRVLLQQEKIIARVSIDNRTRALVQALRRTADPKLCITRVEELTFHLLEFPEGKGVAIKEKIIPYLLRLRQVKDETLQAAVREILALIGYVDPVKGRGIRILTIDGGGTRGVVALQTLRKLVELTQKPIHQLFDYICGVSTGAILAFMLGLFHMPLDECEELYRKLGSDVFTQNVIVGTVKMSWSHAFYDSNTWEKILKDRIGSALMIETARNPACPKVAAISTIVNRGQTPKAFVFRNYGHFPGTNSHYLGGCQYKMWQAIRASSAAPGYFAEYALGSDLHQDGGLLLNNPSALALHECKCIWPDTPLECIVSLGTGRYESDVRNTSTYTSLKTKLSNVISSATDTEEVHIMLDGLLPSDTYFRFNPVICENIPLDESRDEKLDQLQLEGMKYIERNDQKMKKVAKILSQEKTTLQKINDWIKLKSDMYEGLPFFSKLWVGYTCVLINEGHQKIHQFREERCDST

SEQ ID NO: 253 - protein, 91 aa, Equus caballus
MKLAITITLAILALCCSPASAEICQSFADIIQGLFLGTPASFEAAVEPFKPDADMKAATTQLKTLVDFLPKNTKDSILKLMDKIAKSPLCA

SEQ ID NO: 254 - protein, 73 aa, Equus caballus
ALCCSPASAGICQRFVGIVQALYLGTPASFEAAVEPFKPDADMKAAATQLKTLVDFLPKNAKDSILKLMDKIV

SEQ ID NO: 255 - protein, 73 aa, Equus caballus; identical to SEQ ID NO: 254

SEQ ID NO: 256 - protein, 73 aa, Equus caballus; identical to SEQ ID NO: 254

SEQ ID NO: 257 - protein, 73 aa, Equus caballus; identical to SEQ ID NO: 254

SEQ ID NO: 258 - protein, 195 aa, Mus musculus; identical to SEQ ID NO: 90

SEQ ID NO: 259 - protein, 195 aa, Homo sapiens; identical to SEQ ID NO: 89

SEQ ID NO: 260 - protein, 367 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 261 - protein, 327 aa, Homo sapiens
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPGLALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 262 - protein, 229 aa, Homo sapiens; identical to SEQ ID NO: 226

SEQ ID NO: 263 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 264 - protein, 51 aa, Cavia porcellus
HALDTPHFPQELTSALSKNICITFFSGMFKNVESVAEIFDSLGPSFKQDQA

SEQ ID NO: 265 - protein, 467 aa, Canis familiaris
MVSIWTIALFLLGAAKAKEVCYEQIGCFSDAEPWAGTAIRPLKVLPWSPERIGTRFLLYTNKNPNNFQTLLPSDPSTIEASNFQTDKKTRFIIHGFIDKGEENWLLDMCKNMFKVEEVNCICVDWKKGSQTSYTQAANNVRVVGAQVAQMLSMLSANYSYSPSQVQLIGHSLGAHVAGEAGSRTPGLGRITGLDPVEASFQGTPEEVRLDPTDADFVDVIHTDAAPLIPFLGFGTSQQMGHLDFFPNGGEEMPGCKKNALSQIVDLDGIWEGTRDFVACNHLRSYKYYSESILNPDGFASYPCASYRAFESNKCFPCPDQGCPQMGHYADKFAVKTSDETQKYFLNTGDSSNFARWRYGVSITLSGKRATGQAKVALFGSKGNTHQFNIFKGILKPGSTHSNEFDAKLDVGTIEKVKFLWNNNVVNPTFPKVGAAKITVQKGEEKTVHSFCSESTVREDVLLTLTPC

SEQ ID NO: 266 - protein, 229 aa, Mus musculus; identical to SEQ ID NO: 219

SEQ ID NO: 267 - protein, 232 aa, Mus musculus; identical to SEQ ID NO: 224

SEQ ID NO: 268 - protein, 253 aa, Homo sapiens; identical to SEQ ID NO: 239

SEQ ID NO: 269 - protein, 327 aa, Homo sapiens
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGENIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 270 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 271 - protein, 224 aa, Bos taurus; identical to SEQ ID NO: 102

SEQ ID NO: 272 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 273 - protein, 413 aa, Rattus norvegicus
MDRHLCICREIQLRSGLLFPFLLLMMLADLALPAQRHPPVVLVPGDLGNQLEAKLDKPKVVHYLCSKRTDSYFTLWLNLELLLPVIIDCWIDNIRLVYNRTSRTTQFPDGVDVRVPGFGETFSLEFLDPSKRNVGSYFYTMVESLVGWGYTRGEDVRGAPYDWRRAPNENGPYFLALQEMIEEMYQMYGGPVVLVAHSMGNMYMLYFLQRQPQAWKDKYIQAFVSLGAPWGGVAKTLRVLASGDNNRIPVIGPLKIREQQRSAVSTSWLLPYNHTWSHEKVFVYTPTANYTLRDYHRFFQDIGFEDGWFMRQDTQGLVEALVPPGVELHCLYGTGVPTPNSFYYENFPDRDPKICFGDGDGTVNLESVLQCQAWQSRQEHKVSLQELPGSEHIEMLANATTLAYLKRVLLEEP

SEQ ID NO: 274 - protein, 782 aa, Homo sapiens [sequence omitted]

SEQ ID NO: 275 - protein, 806 aa, Homo sapiens; identical to SEQ ID NO: 22

SEQ ID NO: 276 - protein, 752 aa, Homo sapiens [sequence omitted]

SEQ ID NO: 277 - protein, 103 aa, Sus scrofa
MTSKLAVAFLAVFLLSAALCEAAVLARVSAELRCQCINTHSTPFHPKFIKELRVIESGPHCENSEIIVKLVNGKEVCLDPKEKWVQKVVQIFLKRTEKQQQQQ

SEQ ID NO: 278 - protein, 70 aa, Oryctolagus cuniculus
GICPRFAHVIENLLLGTPSSYETSLKEFEPDDTMKDAGMQMKKVLDSLPQTTRENIMKLTEKIVKSPLCM

SEQ ID NO: 279 - protein, 752 aa, Mus musculus; identical to SEQ ID NO: 44

SEQ ID NO: 280 - protein, 752 aa, Mus musculus
MQFFGRLVNTLSSVTNLFSNPFRVKEVSLTDYVSSERVREEGQLILLQNVSNRTWDCVLVSPRNPQSGFRLFQLESEADALVNFQQFSSQLPPFYESSVQVLHVEVLQHLTDLIRNHPSWTVTHLAVELGIRECFHHSRIISCANSTENEEGCTPLHLACRKGDSEILVELVQYCHAQMDVTDNKGETAFHYAVQGDNPQVLQLLGKNASAGLNQVNNQGLTPLHLACKMGKQEMVRVLLLCNARCNIMGPGGFPIHTAMKFSQKGCAEMIISMDSNQIHSKDPRYGASPLHWAKNAEMARMLLKRGCDVDSTSSSGNTALHVAVMRNRFDCVMVLLTYGANAGARGEHGNTPLHLAMSKDNMEMVKALIVFGAEVDTPNDFGETPALIASKISKQLQDLMPISRARKPAFILSSMRDEKRSHDHLLCLDGGGVKGLVIIQLLIAIEKASGVATKDLFDWVAGTSTGGILALAILHSKSMAYMRGVYFRMKDEVFRGSRPYESGPLEEFLKREFGEHTKMTDVKKPKVMLTVTLSDRQPAELHLFRNYDAPEAVREPRCNQNINLKPPTQPADQLVWRAARSSGAAPTYFRPNGRFLDGGLLANNPTLDAMTEIHEYNQDMIRKGQGNKVKKLSIVVSLGTGKSPQVPVTCVDVFRPSNPWELAKTVFGAKELGKMVVDCCTDPDGRAVDRARAWCEMVGIQYFRLNPQLGSDIMLDEVSDAVLVNALWETEVYIYEHREEFQKLVQLLLSP

SEQ ID NO: 281 - protein, 547 aa, Macaca fascicularis
MKFSQKGCAEMIISMDSSQIHSKDPRYGASPLHWAKNAEMARMLLKRGCNVNSTSSAGNTALHVAVMRNRFDCAIVLLTHGANADAHGEHGNTPLHLAMSKDNVEMIKALIVFGAEVDTPNDFGETPTFLASKISRLDTRKAILTLLRTVGAEYCSPPIHGVPAEQGFAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHGKSMAYMRGVYFRMKDEVFRGSRPYESGPLEEFLKREFGEHTKMTDVKKPKVMLTGTLSDRQPAELHLFRNYDAPETVREPRFNQNVNLRPPAQPSDQLVWRAARSSGAAPTYFRPNGRFLDGELLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHHEEFQKLIQLLLSP

SEQ ID NO: 282 - protein, 968 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYK

SEQ ID NO: 283 - protein, 327 aa, Homo sapiens
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 284 - protein, 346 aa, Homo sapiens; identical to SEQ ID NO: 96

SEQ ID NO: 285 - protein, 224 aa, Bos taurus; identical to SEQ ID NO: 102

SEQ ID NO: 286 - protein, 229 aa, Mus musculus
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRHAQAKIIVLGLLPRGEKPNPLRQKNAKVNQLLKVSLPKLANVQLLDIDGGFVHSDGAISCHDMFDFLHLTGGGYAKICKPLHELIMQLLEETPGEKQTTIA

SEQ ID NO: 287 - protein, 232 aa, Mus musculus; identical to SEQ ID NO: 224

SEQ ID NO: 288 - protein, 346 aa, Homo sapiens; identical to SEQ ID NO: 96

SEQ ID NO: 289 - DNA, 15715 bp, Homo sapiens
aagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggtgaggcacgggtctcgtggtggatctgtcggtcgggcgggacgggccgcgggcggggctgccttcccggtctgcttctgttccagtcacgaaatgggggagcgtattggtatctgtcttgtcacttaggtgatctagatctgccggctcacctcccgccatgctgggcgcgggtgtggtcagctccccacctcctgtcctggtagaaaatgggggtgagtgggagagttaccatctggttattcatagttccacctgtccgcatcattcccaagccttgcctccccttatcccatttttaagctggaaagacaggtgcttcagccccactcctgagggatggtgggggtgtgtagagtggctcctgagttgacttctgcatcgacctgggcctggttaggaggctgtcaccctcgacccctccaatgccacatatgccagaaggcattgctgaaaggaacctccttagggaaaggattgctgtcctagctggccaccaactcccacaacttatcagatgtgtggcattgcctgagggaaaaggcctaagggaaactgaagacaactgaagtcaggggaaagggttgggacaatggccatgaacctgtgtcaggcaacatgcttgtactcttaccctgccacacatgcttggactagactatgtggaggctcggtgacctcccctgctcaccccgctccttgatcacaaccctggcaactctacaacggccactgtatttccttgcagggatgggcagggatgagacctctgtctggggggccttgggtgcctcattgaggccgtcactcccatccagagctggtgtgtccgtggccagccaggattcctgaaagcagaggcatctgaggcatgaattacacgtggagtctagtgcagcatgatctccatgctctttctgctgagagtactttaaatggggacgatgcaaatcacagaagggtagagttggcaggtagggtggtgccaggcaggccccaccaggagttcccagccaggaaaagctccagggggatactaggcccaggttcaccatgggatttgggcagacttggccctgcctccccaaagcttgcaggataggaataacagtgatccccagagaggaagtctgtgtggggcaagcacagagaatccaccaacccagcctggatgggtgggtgtcaagtaaggcttcctggagtatatagctggagctaaggccaggagagagtaatgggtcggggagagacgtgagcatctcaggctgcctgggatcgagtcacaggaggagtggactgcacaggacttgtgactggttgggtcatctgaactttatcttgagggcctcagggagtcctgggttggcctgcagagttctaagtctgaggggcgtggcattaggaagcatgtggtctgtggcacacaaaatggcacatagccattttgcctggattgatgctaaccgcactcatcaattcagtcagtctgtttatccttggtcacagcagaagagcctcagaccccacccagaatcacagagcagcaggagtcctaacatgcccagcttctcagggagtgaggctgctggccttagccctgggagacctcacggtgggcagttggataagcagctcctgggcacagagcagggatctgaccttgactgtcagaagatcagaatcctctaggggtggatcctgaaatggtggtggaggaaagagagaccagcgatgtgatacagaagaccctgggcaaggggaagggaccataggcaaggccatttccacctcttgcagcctcagtctccccatctgttaagtggaaatagtaaggctgtcccctcccagtgttacttgaggtgaaaggcatgtggatggctcttttcctagttccaggcgcagatgggctcaggaagtggccactgctatttttaggggccacacagcctgaccagggtaaggagcatctgagcaaagcagatctggtgacttcctcttttaccatttcccctttggtagagacagtgaccagggtctctgccctgccctgcccagtccacaggcatgtcatccagaggctgtcatgacagggactccctccctctgcacccataccatgaagggaggtgaaggcatgtgccgcccctgcctctcatggcaccctgaagacactgggatggtgcccagggagggcacgccctgttcagggtggatttacggtcagttcccagtgaatgtccaggagagccaagtgctggtttttcactcaatgatcatggaccctaaacggggatgtgtttgggaagtggcgagagcatggcatgtgggggcaggtgaggcccgaaaggtcaatgggagtaacgagactgtgaagggctttgacgcagtggggagggatttgggtgtcaccagggccccagagttctgagtacactgaataggatggctgggatggagagaagtcaccctagggcctggactgtggtgataatggtgctggttcagggtggctgtttccaatacgggctcccagccatgctagggccctccagatgatctgctctctggcaccttactggactctggcctttagtaaggcctgggcccttggtaggctggcgggtgccaatgtaagcttctctcagctgtgtttctgttcatttccctcccaccagcctgtcctgcatactttgtctggttgaattttagctgagtggcccagggctctgttctgtttccttcttcctctctcagggcgaacaggaccctgtcttctatgtagcctgggatagctatgggtggaagacttttgggttcaagcctccagggtatatatctttttttttttttgagaccgggtcttgctctgtcacccaggctggagggcaatggcacgattttggctcactgcaacctctgcctcccgggttcaagcaattctcctgtcttaggctcctgagtagctgggattacaggtgtgtgccaccacaccaaggtaattttttgtatttttagtagagatgggctttcaccatattggccaagctggtcttgaactcctgaccgcaagtgatccactcacctcggcctcccaaagtgctgggattacaggcatgagcccctgcgccctgcctcgaaggtatatatctaatgacaagggccttggccaaactttggaggttctggaatgcaaaggggtctccaagcccctcctcccaggcagagctcccatcggggtccattaaccatagaaaccatgtgtagaggtgtgtctgtgtttgctgggggtgattcagaccaagatctcatttaacagatacggaaactgaggcctagtgtggggagtgacttcaccctgaacccccttccaataatctgaatggcccaggaggatgttccagtgaaaatccaggagacttactttatctggagttggagacaatgttagggcccttccccaaacatgtcaggcctctcccaagccccccacaggcatctctgcaccacacagcagtagcagcttttctgcacaaagatggttccctggcctttgggtcaaggtccctgctctctgaatttcctgccaccagcactgtgctttaatttgagatgtggaactgcacaggtctgccatattatctgtggctcttcagggggtctgctgcagacatcaaagttcttgggagtcttgaacctgccgggctgagggctcacacatgtcctgtgccccctgcagtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggtgggggctggggcacacagaggggggtgctgctcaccaacagtgcctgagaggcctccagagtctgttccttctatcctcatctcgaggtcactgacctctctccttccccaggtcctcggtctggtctggtctggtctggttggcaccacctctgcactcccaggcagaactaactttcccttcctgctgcccttgttcctctactctccagtcctggcctctcatgcctacacacaattttttttttcttttattttgggatggagtcttgctgtgtcactcaggctggcgccatctcagctcactgcaacctccgtctcccaggttcaagcgattcttgtgcctcagcctcccaagtagctgggattacaggtgcccgccaccatgcctggctaattttttgtatttttagtggagatggtgtttcaccatgttggccatgctggtcttgaactcctgagctcaagtgttctgcccaccttggactcccaaagtgctgggattacaggcatgagccactacgcctgcctacacaaaatttctgtgtcccagcccctattcagagcctcggcatggcccccacccctttccttgtctgtgcctcggcctcccctacctctccagctgcttattcttcttgggacatgccatgtctttgtacctgctgttcttttggcctggaatctatttctacaccctttgcctgataaatggcttccattcacttttttttttttttttttttttggagacggagttttgctcttattgcccaggctggagtgcaatggcgcgatctcggctcacaactcttttttttttttttaacttttattttttgagacagagtcttgctctgtcgcccaggctgggtgcagtggcgctatctcggctcactgcaagctccgcctcccgggttcacgccattcttctgcctcagcctcccaagtagctgggaccacaggcgcccgccacagtgcccggctaattttttgtattttttagtagagacagggtttcaccgtgttaaccaggatggtctccatctactgaccttgtgatccgcctgcctcagcctcccaaagtgctgggattacaggcgtgagccaccacacccagccccattcactctttaaaacatgaccctaggccaggcatggtggctctgctataatcccatcactttgggaggctgaggcagtcagatcacctgagctcaggagttgaagaccagcctgggcaacttggtgaaaccccatctctaccaaaaatacaaaaaaattagctgggcatggtggcatgcacctgtagtcccagctacttagggggctgaggcaggagaattgcttgagccagggaagcagaggttgcagtgagcagaccactgtacccagcctgggttgcagagcaagaccctgtctcaaaacaacaaaaacctgaccctggtccctttgtgacatgtcccttttgactccccagagcggtttgcctctcctcccaggccccatgcttgcttcctctaaacatcatcatgtgcccgaatttgtctgcaggcatgtttgcccaaattgcacaggcactgtacattttatatactttctttcagttagtcttacagcaaccccgttttgaaataggtgctgttttctttttttttttttcaccagtgttacttgccaacaggtggtttttaaacctgctttacaactgcgaaatctggaggctcaatgaggttacaaaattgactgtgctcactcagctaataagtggtagaatcagaattcaaatccagaatgtgtggcgttgagctgaggttccctcccaggctgagttccgtgaagggagggagtgtgtgtctgttttatccttatagcagtagaaccagaaacacagttggcgcctgataaatgtttgagctgaatggagtctcccaaattaaaagtttttcctggtcgggtgcggtggctcatgcctgtaatcccagcactttgggaggctgaggtggacagatcatgaggtcaggagttcgagactagcccggccaacacagtgaaaccctgtctctactaaaaatgcaaaaattaaggccgggcatggtggctcacgcctgtaatcccagctagtcaggagtctgaggcaggagaaacgcttgaacctgggtggtggaagttgcagtgagctgagatcgtgccattgtactccagcccaggtgacagtacaagactccatctcaaaaaaaagaaaatacaaaaatacaaaaatgagccgggcgtggtggcacacgcccatgatcccagctactcgggaggctgagacaggagaatcacttgaacctgggaggcagaggttgcagtgagcagagatgggggcactgcactctagcctgggtgacagagcgagactgtctcaaaaaaaaaaaaaaaaaaaagtttttcccagagacccgctagctgctcctccaggtgccctggcctgccggctgtttgtgatgcccattttgatgactccttcctcctctgtgtgttgtgtgactggggttatttctgggctgttgatgtgcatttctatttttatactggggacacagcctcaggtgctgccagttggaggtgccagctgataccaagaggggcctgtctgccttcactgcttctctgacccgtttagattttcacccagcgcagaactgctttggctttccagaacagttttctgcattttgctgtttgataatttatttttagtagcaacaagctactttgctatgtggtcattgggataatctacaaattgccctggagagaatgggcctccaggacctgttatctgggtcagttgtggggatcctgtcagcttcagtggctgatatctaagtgggcaagtgggactcaggaccaccagaaactccaggttcctgtgttttgggggcacatttgcttcttcagtgtgtggcgaggccagagcaaggttcccagcctcgcacagaggcacaaggcttttctcctggtataaggtgtctcccctggcccatcaccctgttcccatcatttcttcaggccttgacaaccctcttcccacaggagatggtgcagcagctgtgtactgagccctgaggcggggtctgtcctgtctggttctgtttggcactgcagctacagaaactatgagatcacgtgtgtggtgttagaagctgctgagtctgtggtaatttattacacagttctagaaaactaataggctgggtgcagtggctcacacctataatcccagcactttgggaggctaaggcaggaggatcgcttgagcccaggagtttgagaccagcatgagcacatagtgtggccctgtccctacaaaataaataaacaaataaataaataaattagccagacctggtggtgcctgcctagctgttcaggagggtgaggtaagaggatcacttgagcccaggaggttatggctacagtgagctatgatctcctcactgtgctgcagcctgggcaacagagtgagaccctgtctcaaaaaagaagaagaaagaaaagtaagaaagggctgttagggatcttaagtcagtagctggtggtccatgtcctatgtcatggcgcttaggaatttgctgggcaagccctgagccttgtggctgcagtctgacagttgatacagccctggggtactgggaggtcataggagcatggttcattcccttcctccatggaggatgtgtttggaggttggctggctgctgtgtccaatgcgcagaggaagcgggacccaattatacctacctggggccacacaaggccttcctcctgtctctccccaccagctcccatcatttctctgggccttgctccttctcctacctgcctacccacccatacagcagccctgaggcatggtgcctttctagggtttgtttttgtttgtttgtttgtttttttgagacagagtttcgctcttattgcccaggctggagtgcagtggcgcaatctcggctcactacacctctgcctcccaggctcaagcacttctcctgcctcagactccggataactgggattacaggtacacgtcaccatgcctggttaatttttgtgtttttagtagagatggggtttcaccctgttggccaggctggtctcgaactcctaacctcaagtgatccacgtgcctcagccttccaaagtgctgagattataggcgtgagcccctgtgcctggcctagtgtgttttgttttgttttttttttttttttgagacagggtcttactttgctgcccaggctggtgtgcagtggcatgatcacggctcactgcagcctcaatatcccaggtgcaagtcatcctcctgcctcagccttccaagtagctgggaccacaggcctgcaccaccatgcctggctaattttttatttttagtagcaacaaggcctcactgtattgcccaggctggccttgaactcctggcctcaagcattcctcccaccttggccttgcaaattgttggaactacaggtgtcagccactgcacccggcccctgtctggttctgttgtgtactgcactcaccacctccttcacctgggatacgttgggctggcaggagctggatgcaaggagatggagcgatggaaagctgaaagagggtagactgcctcttggggtccagtgtgaagttcacggcagaatcaggactggtacttccttctcccaaccaggtccaagaccctcattctagagtagggtcacgggggagaggggaatgttgctttgacaggggtcctggggtcagtatttggagtaagtatgccttggtggggtcctcatttggatgtaattactctgatctgtgctttttatttttatttatttatttatttatttatttatttatttatttatttttttgagacagagtcttgctctgtcgcccaggctggagtgcagtggtgtgatctcagctcactacaacctccgtgtcacaggttcaagcgattctcctgcctcagcctcctgagtagctgggattacagtcgcctcccacgacacccggctgattttgtatctttagtagagatggggtttcgccatgtttgtcaggctggtctcaaactcctcactcaggtgacctgccagcctcagcctcccaaagtgctgggattaacaggcgtgagccactgcacctgggcaatttttgtatttttagtagagacagggtttcaccatattggccaggctggtttcaaactcctgacctcaagtgatcctcccacctcagcctccctaagtgctgggattacaggtgatctgtgctttatcaacctgctttgttacttttcggtctctcctatccatctgaccaaacctgggcatgagaagggagtatgactcaggacatgatgcactgttgggacacaccaagctcagtgtcccctccgggtcactggctcaatatcctctcacaacaggctggtttacaacaaaacatccagggccacccagtttcctgatggtgtggatgtacgtgtccctggctttgggaagaccttctcactggagttcctggaccccagcaaaagcagcgtgggtatgtagcccttactcaaggcctccgggagctgggatggggtttctgccggactggagctggagctggaggaactctgctggtttgtagggacagcctgtgagctgtctctgatcagcgtgggcacagagccctgtagcattcttccaaggacctgctagctgtcacagtctccatgctgggcatagtgtaggtggccggcactagctgtatcttttcttatcctctgtatttctgtctacaggttcctatttccacaccatggtggagagccttgtgggctggggctacacacggggtgaggatgtccgaggggctccctatgactggcgccgagccccaagtaagcaggcactctcattccctccctgacgtctcgggaggtaggggtgaggtgatcatgggcaccacagaccttgggctctccccttgtccttggctgtctcctgtccctgggcctctggcatccagtctagtggtcacagccaccacctttggtcagtcttatcctgtcctccatttcccaccctgggacctctgggcctgtgagccctggggagaaatataaggcttcctcccttcatggaaggcggggggacccagaccgctctgtttgaatgtgagcaccctcccctccccctctcgtcttgtgtctggcctgagaaaagctcagtggttccggctccaggacccttcccacctgacccctgcctggctctggcctgcagatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggtaagaccctacctggcccagcgtggggggctgttgccaggaattctgccctctcttcccttcctaagtgtcctcctgggccagcatgcctcgtgtctgtcccacggtgtgtggggtctatgcaaatctacccctaaaagtccaaagaagaaagaggctgacaaatctagtttctcagagaaaagcatttaatagggacatacgaatagaagccacatctgtgtctcaggtgggggcaagacaagatggtggatccccacactattagcccccagacccagagcttatattctgtagggaaagggcgactccgatgcgatgtgttgaacattgaaggatgataacacagaggctgttttgatttatggttaagtacgtgcacaagaaacagtagataaagtggaaatctcagtggccttcctggatctggggttaatcagaagccaacatggtggattagtatccaaaatggagttgctttggtctccacaatgactattctcttgggtcagccctgttttttttttaatttttattttttgagacagagtctggttctgtcacccagactggaatgcagtggtgcaatcttgtctcactgcaacctctgcctcccgggttcaagcgattctgcctcagcctcctgagtagctgggattacaggtgcccgccaccatgcctggctaagttttgtgttttagtagagatgaggtttcatcatgttggccaggctggtcttgaactcctgacctcagatgttccactcgcttcggcctcccaaagtgctgggattacaagtgtgagccactgtgcctggccatccctccctcttaccccatccttacttcttcatccccaccttcaccgcagaggaggaaggctagagcattttttttttttttttggaggcagggtctttctcactctgccatccaggttggagtgcagtagcgtgattttggttcatgcaacctccaccttccaggttcaagtgattctcctgcctcagcctcccgggtaactgggactacaggcgcgtaccaccacacccggctaatttttgtatttttagtagagactgggtttcactatgttggccgggctagtctctaactcctgacctcaagtcaggaggatctgcctgcctcagcctcccaaagtgctgggattacaagcatgaaccaccgcacccggccagatttttttgtatttttagtagagatggggtttcaccattttggtcaggctggtcttgaactcctgacctcaaatgatctgcccaccttgacctcccaaagttctgggattacaaggatgagccactgcacctggcctctagactacagttttttatttatgagttgcgcctccatctgtgggcagcacggagcctctgtaggcaacacagggaggaagcaggtgcagatctggctgggcctgcttgcctggcaattgggaaagccaccccttttatggctcctcccccgtcttttcatgactgttgcagctcaccagctgcagctgtagagtagagcttcttcctctagaagggagctttcctccctctgctaggacttgggggaggcttatggaccctcactttgggagctatgagccagggctgtgccaagcatctcatgagctcaagtgcctgccactgcttgacctgcttggtctactggcattgtgattgggtcaggcccagtgactctgagttggctggaagacactcagatttagtgaggactcattatagccaccacttcggtctagcctgggcctggagggacggatgtgggcataccctgagtttagacaggtagccccggcccctttcagagtttctctgtgagtccccttagagctttgtttcaaaggctgggaagctgttctgtcctgccttggcagtccaggactgggtgtgtggtgcggggaggtggaagtccgtgcacccctaggggctttccttgcctcaggggtcccccagccaggccacagcaggcagagctgaggccctacagtcagtctgagaggcctccctgctttcagatacagggtggggtgatgggtgaccatggatcctgaacaggccagaggcccctgttcccaagttgcagcttttacttcctggaggcctccctgactgccgggtgtttgtgttgttcacattcctgtgtatagggactccgcctccatctgcagcctcccctcgtgccctgtctccagcacgcctggctgcccaggtcagcgcacatgcaagtgggtggaatgaggccacggctggctgaacgctggtctgagcttaggaaaagaaaaactggtacacagttcagtgtcataaaagggaaagcagaacatgtcatctccgagttgccaacctgctgactcactttagactaggtcagtgcccacaggcctgatcagcacttggaggatggtagagtttacaggcaaggaagcatcataaatcaccctgtgggtatgtgccgccttactccctggtgaggaaagcaaaaaaaacaaaacatagcttggatgtgtggttcccagatgtagcaaaaataaagagaaacaataaaagccaaggcaagcaaactgggcaacatagcaagaccccatctgtataaaaagtggaaacatttttagcccaggcgtggtgggacgtgcttgtagttccagctatgcaggaggctgacataggaggatcacttgaacccaggaggtggaggttgtagtgagccaagactgtaccactgcactccagcctgggtgacagaatgagaccctacttcaaaaaaaaaaaaaaggaaaaatttgccaggcatgaggcatggtggcgcatacctgtagtcccagctactccaaaggctgaggcgggaggattggttgagcctgagaggttgaggctgctgtgagccgtgatcatgccattatactccagcctgggcaacagagtgagaccctgtctcaaaaagaaaaaaaaagagccaaggcagggatgggagtcacagtgattacaatgatgataaccgggtagagatgcgggactgtggactgggcccctggctggggtctggcaggggcctggtggtgaacatgctgcccaaccagctggcattcctaagcacagactgaccagagccttctccctgcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcacgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaa

SEQ ID NO: 290 - DNA, 2764 bp, Homo sapiens
aagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctggtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggctggtttacaacaaaacatccagggccacccagtttcctgatggtgtggatgtacgtgtccctggctttgggaagaccttctcactggagttcctggaccccagcaaaagcagcgtgggttcctatttccacaccatggtggagagccttgtgggctggggctacacacggggtgaggatgtccgaggggctccctatgactggcgccgagccccaaatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcacgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaaaaaaaaaaaaaaaaaaaaaaaaaaaaaaaaaaaaaaaaaa

SEQ ID NO: 291 - protein, 9 aa, Artificial Sequence
  Synthetic peptide
CYGGRGDTP

We claim:

1. A method for diagnosing systemic lupus erythematosus (SLE) comprising:
 assaying a sample from a patient for the presence or absence of lysosomal phospholipase A2 (LPLA2); and
 determining LPLA2 enzymatic activity in a sample from said patient, wherein LPLA2 enzymatic activity is decreased in the patient compared to LPLA2 enzymatic activity in a patient that does not suffer from SLE, and wherein said decreased enzymatic activity is suggestive of a diagnosis of SLE in the patient.

2. The method of claim 1, wherein LPLA2 enzymatic activity that is decreased in the patient compared to a prior LPLA2 enzymatic activity in the same patient is suggestive of the diagnosis of systemic lupus erythematosus.

3. A method for diagnosing systemic lupus erythematosus comprising:
 determining lysosomal phospholipase A2 (LPLA2) expression in a sample from an individual, wherein decreased LPLA2 expression in the individual compared to LPLA2 expression in an individual that does not suffer from systemic lupus erythematosus is suggestive of a diagnosis of systemic lupus erythematosus in the individual.

4. The method of claim 3, wherein LPLA2 expression level that is decreased in the individual compared to a prior LPLA2 expression level in the same individual is suggestive of the diagnosis of systemic lupus erythematosus.

* * * * *